United States Patent 12,599,070 (GENETIC LOCI ASSOCIATED WITH DISEASE RESISTANCE IN SOYBEANS) - sequence listing, part 2

SEQ ID NO: 1 - DNA, 5166731 bp, Glycine clandestina (residues 1,722,245-3,444,488 of 5,166,731)
  misc_feature (17726)..(17726): n is a, c, g, or t
  misc_feature (32023)..(32125): n is a, c, g, or t
  misc_feature (39492)..(39501): n is a, c, g, or t
  misc_feature (42725)..(42725): n is a, c, g, or t
  misc_feature (43747)..(44693): n is a, c, g, or t
  misc_feature (46850)..(47534): n is a, c, g, or t
  misc_feature (51356)..(51395): n is a, c, g, or t
  misc_feature (55018)..(56986): n is a, c, g, or t
  misc_feature (63435)..(63473): n is a, c, g, or t
  misc_feature (78686)..(78720): n is a, c, g, or t
  misc_feature (87711)..(87736): n is a, c, g, or t
  misc_feature (88800)..(88892): n is a, c, g, or t
  misc_feature (99662)..(100291): n is a, c, g, or t
  misc_feature (100725)..(100796): n is a, c, g, or t
  misc_feature (101514)..(101523): n is a, c, g, or t
  misc_feature (104149)..(104268): n is a, c, g, or t
  misc_feature (104561)..(104676): n is a, c, g, or t
  misc_feature (116599)..(116619): n is a, c, g, or t
  misc_feature (117799)..(117848): n is a, c, g, or t
  misc_feature (138741)..(138774): n is a, c, g, or t
  misc_feature (151441)..(152399): n is a, c, g, or t
  misc_feature (155921)..(156471): n is a, c, g, or t
  misc_feature (157927)..(158005): n is a, c, g, or t
  misc_feature (160012)..(160336): n is a, c, g, or t
  misc_feature (176635)..(176662): n is a, c, g, or t
  misc_feature (199150)..(199150): n is a, c, g, or t
  misc_feature (243771)..(243776): n is a, c, g, or t
  misc_feature (247513)..(247515): n is a, c, g, or t
  misc_feature (258810)..(258846): n is a, c, g, or t
  misc_feature (263629)..(263645): n is a, c, g, or t
  misc_feature (272231)..(272482): n is a, c, g, or t
  misc_feature (289741)..(289778): n is a, c, g, or t
  misc_feature (297584)..(297593): n is a, c, g, or t
  misc_feature (307524)..(307594): n is a, c, g, or t
  misc_feature (316377)..(316397): n is a, c, g, or t
  misc_feature (320205)..(320207): n is a, c, g, or t
  misc_feature (337342)..(337391): n is a, c, g, or t
  misc_feature (361388)..(361393): n is a, c, g, or t
  misc_feature (385450)..(385460): n is a, c, g, or t
  misc_feature (385779)..(385788): n is a, c, g, or t
  misc_feature (388072)..(388604): n is a, c, g, or t
  misc_feature (395035)..(395201): n is a, c, g, or t
  misc_feature (424413)..(424456): n is a, c, g, or t
  misc_feature (433347)..(434192): n is a, c, g, or t
  misc_feature (436994)..(437003): n is a, c, g, or t
  misc_feature (446264)..(446936): n is a, c, g, or t
  misc_feature (450900)..(451231): n is a, c, g, or t
  misc_feature (460033)..(460051): n is a, c, g, or t
  misc_feature (460621)..(460646): n is a, c, g, or t
  misc_feature (461120)..(461200): n is a, c, g, or t
  misc_feature (462328)..(462541): n is a, c, g, or t
  misc_feature (468079)..(468242): n is a, c, g, or t
  misc_feature (472105)..(472137): n is a, c, g, or t
  misc_feature (473423)..(473432): n is a, c, g, or t
  misc_feature (480790)..(480977): n is a, c, g, or t
  misc_feature (481389)..(481398): n is a, c, g, or t
  misc_feature (483211)..(483220): n is a, c, g, or t
  misc_feature (488427)..(488436): n is a, c, g, or t
  misc_feature (495704)..(496058): n is a, c, g, or t
  misc_feature (516998)..(517016): n is a, c, g, or t
  misc_feature (551129)..(551456): n is a, c, g, or t
  misc_feature (558768)..(558776): n is a, c, g, or t
  misc_feature (564377)..(564455): n is a, c, g, or t
  misc_feature (585847)..(585970): n is a, c, g, or t
  misc_feature (600682)..(600713): n is a, c, g, or t
  misc_feature (602366)..(602394): n is a, c, g, or t
  misc_feature (611830)..(611877): n is a, c, g, or t
  misc_feature (619204)..(619231): n is a, c, g, or t
  misc_feature (630263)..(631076): n is a, c, g, or t
  misc_feature (631492)..(631501): n is a, c, g, or t
  misc_feature (654684)..(654727): n is a, c, g, or t
  misc_feature (699736)..(700324): n is a, c, g, or t
  misc_feature (701989)..(702920): n is a, c, g, or t
  misc_feature (706430)..(706454): n is a, c, g, or t
  misc_feature (709146)..(709329): n is a, c, g, or t
  misc_feature (712225)..(712242): n is a, c, g, or t
  misc_feature (715243)..(715265): n is a, c, g, or t
  misc_feature (731428)..(732581): n is a, c, g, or t
  misc_feature (733219)..(733289): n is a, c, g, or t
  misc_feature (744250)..(744408): n is a, c, g, or t
  misc_feature (795817)..(795832): n is a, c, g, or t
  misc_feature (853224)..(853344): n is a, c, g, or t
  misc_feature (856035)..(856098): n is a, c, g, or t
  misc_feature (857137)..(857163): n is a, c, g, or t
  misc_feature (874275)..(874284): n is a, c, g, or t
  misc_feature (875085)..(875094): n is a, c, g, or t
  misc_feature (887116)..(887207): n is a, c, g, or t
  misc_feature (887426)..(887500): n is a, c, g, or t
  misc_feature (887676)..(887979): n is a, c, g, or t
  misc_feature (911098)..(911163): n is a, c, g, or t
  misc_feature (919760)..(919898): n is a, c, g, or t
  misc_feature (930727)..(930804): n is a, c, g, or t
  misc_feature (931085)..(931129): n is a, c, g, or t
  misc_feature (933645)..(933674): n is a, c, g, or t
  misc_feature (937513)..(937610): n is a, c, g, or t
  misc_feature (945613)..(945643): n is a, c, g, or t
  misc_feature (958592)..(958592): n is a, c, g, or t
  misc_feature (960133)..(960142): n is a, c, g, or t
  misc_feature (964349)..(964409): n is a, c, g, or t
  misc_feature (981912)..(981999): n is a, c, g, or t
  misc_feature (983839)..(983846): n is a, c, g, or t
  misc_feature (988539)..(988665): n is a, c, g, or t
  misc_feature (1001702)..(1001881): n is a, c, g, or t
  misc_feature (1004098)..(1004107): n is a, c, g, or t
  misc_feature (1006580)..(1007482): n is a, c, g, or t
  misc_feature (1009490)..(1009499): n is a, c, g, or t
  misc_feature (1012565)..(1012574): n is a, c, g, or t
  misc_feature (1020103)..(1020190): n is a, c, g, or t
  misc_feature (1025082)..(1025091): n is a, c, g, or t
  misc_feature (1026448)..(1026457): n is a, c, g, or t
  misc_feature (1031811)..(1033200): n is a, c, g, or t
  misc_feature (1034913)..(1034922): n is a, c, g, or t
  misc_feature (1040561)..(1040887): n is a, c, g, or t
  misc_feature (1055241)..(1055698): n is a, c, g, or t
  misc_feature (1057517)..(1057916): n is a, c, g, or t
  misc_feature (1068646)..(1068669): n is a, c, g, or t
  misc_feature (1077296)..(1077336): n is a, c, g, or t
  misc_feature (1086942)..(1087193): n is a, c, g, or t
  misc_feature (1092011)..(1092140): n is a, c, g, or t
  misc_feature (1119867)..(1119870): n is a, c, g, or t
  misc_feature (1121467)..(1121748): n is a, c, g, or t
  misc_feature (1127108)..(1127182): n is a, c, g, or t
  misc_feature (1127884)..(1127893): n is a, c, g, or t
  misc_feature (1132417)..(1133513): n is a, c, g, or t
  misc_feature (1134833)..(1134954): n is a, c, g, or t
  misc_feature (1147216)..(1147347): n is a, c, g, or t
  misc_feature (1171344)..(1171353): n is a, c, g, or t
  misc_feature (1184850)..(1185507): n is a, c, g, or t
  misc_feature (1206986)..(1207035): n is a, c, g, or t
  misc_feature (1209631)..(1209660): n is a, c, g, or t
  misc_feature (1218894)..(1218965): n is a, c, g, or t
  misc_feature (1228563)..(1228631): n is a, c, g, or t
  misc_feature (1265513)..(1265527): n is a, c, g, or t
  misc_feature (1328174)..(1328189): n is a, c, g, or t
  misc_feature (1337233)..(1337642): n is a, c, g, or t
  misc_feature (1338383)..(1338392): n is a, c, g, or t
  misc_feature (1363967)..(1363999): n is a, c, g, or t
  misc_feature (1371771)..(1371777): n is a, c, g, or t
  misc_feature (1378438)..(1378551): n is a, c, g, or t
  misc_feature (1389271)..(1389271): n is a, c, g, or t
  misc_feature (1390632)..(1391076): n is a, c, g, or t
  misc_feature (1391423)..(1391432): n is a, c, g, or t
  misc_feature (1399680)..(1399689): n is a, c, g, or t
  misc_feature (1400115)..(1400124): n is a, c, g, or t
  misc_feature (1406343)..(1406841): n is a, c, g, or t
  misc_feature (1411397)..(1412003): n is a, c, g, or t
  misc_feature (1415980)..(1416085): n is a, c, g, or t
  misc_feature (1424885)..(1425582): n is a, c, g, or t
  misc_feature (1444163)..(1446013): n is a, c, g, or t
  misc_feature (1467605)..(1467614): n is a, c, g, or t
  misc_feature (1471992)..(1472769): n is a, c, g, or t
  misc_feature (1479445)..(1481083): n is a, c, g, or t
  misc_feature (1483990)..(1484037): n is a, c, g, or t
  misc_feature (1498487)..(1498759): n is a, c, g, or t
  misc_feature (1501191)..(1501700): n is a, c, g, or t
  misc_feature (1520483)..(1520679): n is a, c, g, or t
  misc_feature (1535788)..(1535966): n is a, c, g, or t
  misc_feature (1544925)..(1545074): n is a, c, g, or t
  misc_feature (1546399)..(1546988): n is a, c, g, or t
  misc_feature (1547537)..(1547546): n is a, c, g, or t
  misc_feature (1547831)..(1547863): n is a, c, g, or t
  misc_feature (1562898)..(1562907): n is a, c, g, or t
  misc_feature (1563731)..(1564243): n is a, c, g, or t
  misc_feature (1585337)..(1586304): n is a, c, g, or t
  misc_feature (1622861)..(1622870): n is a, c, g, or t
  misc_feature (1627479)..(1627528): n is a, c, g, or t
  misc_feature (1627883)..(1627892): n is a, c, g, or t
  misc_feature (1636058)..(1636067): n is a, c, g, or t
  misc_feature (1636427)..(1636436): n is a, c, g, or t
  misc_feature (1652694)..(1652704): n is a, c, g, or t
  misc_feature (1666452)..(1666881): n is a, c, g, or t
  misc_feature (1674937)..(1674961): n is a, c, g, or t
  misc_feature (1691885)..(1692406): n is a, c, g, or t
  misc_feature (1708701)..(1709019): n is a, c, g, or t
  misc_feature (1709650)..(1709659): n is a, c, g, or t
  misc_feature (1714229)..(1714237): n is a, c, g, or t
  misc_feature (1723617)..(1723626): n is a, c, g, or t
  misc_feature (1723893)..(1723902): n is a, c, g, or t
  misc_feature (1724176)..(1724185): n is a, c, g, or t
  misc_feature (1725939)..(1728132): n is a, c, g, or t
  misc_feature (1738771)..(1738780): n is a, c, g, or t
  misc_feature (1739161)..(1739183): n is a, c, g, or t
  misc_feature (1740019)..(1740028): n is a, c, g, or t
  misc_feature (1750387)..(1750422): n is a, c, g, or t
  misc_feature (1756481)..(1756624): n is a, c, g, or t
  misc_feature (1757003)..(1757012): n is a, c, g, or t
  misc_feature (1768100)..(1768100): n is a, c, g, or t
  misc_feature (1774940)..(1774983): n is a, c, g, or t
  misc_feature (1787268)..(1787501): n is a, c, g, or t
  misc_feature (1787864)..(1787873): n is a, c, g, or t
  misc_feature (1788195)..(1788204): n is a, c, g, or t
  misc_feature (1795122)..(1795125): n is a, c, g, or t
  misc_feature (1795556)..(1795556): n is a, c, g, or t
  misc_feature (1798042)..(1798100): n is a, c, g, or t
  misc_feature (1798678)..(1799821): n is a, c, g, or t
  misc_feature (1823325)..(1823334): n is a, c, g, or t
  misc_feature (1823945)..(1823954): n is a, c, g, or t
  misc_feature (1846773)..(1846853): n is a, c, g, or t
  misc_feature (1887542)..(1888299): n is a, c, g, or t
  misc_feature (1900064)..(1900202): n is a, c, g, or t
  misc_feature (1901396)..(1901405): n is a, c, g, or t
  misc_feature (1903810)..(1903819): n is a, c, g, or t
  misc_feature (1904185)..(1904194): n is a, c, g, or t
  misc_feature (1941956)..(1941965): n is a, c, g, or t
  misc_feature (1951137)..(1951144): n is a, c, g, or t
  misc_feature (1957079)..(1957326): n is a, c, g, or t
  misc_feature (1961599)..(1963059): n is a, c, g, or t
  misc_feature (1964233)..(1965094): n is a, c, g, or t
  misc_feature (1977479)..(1977488): n is a, c, g, or t
  misc_feature (1993667)..(1993674): n is a, c, g, or t
  misc_feature (2009839)..(2009901): n is a, c, g, or t
  misc_feature (2010211)..(2010220): n is a, c, g, or t
  misc_feature (2011693)..(2011702): n is a, c, g, or t
  misc_feature (2016130)..(2016611): n is a, c, g, or t
  misc_feature (2033176)..(2033185): n is a, c, g, or t
  misc_feature (2055745)..(2055771): n is a, c, g, or t
  misc_feature (2058326)..(2059173): n is a, c, g, or t
  misc_feature (2073566)..(2073641): n is a, c, g, or t
  misc_feature (2073950)..(2074066): n is a, c, g, or t
  misc_feature (2074347)..(2074356): n is a, c, g, or t
  misc_feature (2078102)..(2078927): n is a, c, g, or t
  misc_feature (2085278)..(2085284): n is a, c, g, or t
  misc_feature (2093143)..(2093182): n is a, c, g, or t
  misc_feature (2110431)..(2110532): n is a, c, g, or t
  misc_feature (2116619)..(2117137): n is a, c, g, or t
  misc_feature (2136107)..(2136116): n is a, c, g, or t
  misc_feature (2136949)..(2136991): n is a, c, g, or t
  misc_feature (2144082)..(2144091): n is a, c, g, or t
  misc_feature (2148206)..(2148305): n is a, c, g, or t
  misc_feature (2148858)..(2149345): n is a, c, g, or t
  misc_feature (2154338)..(2154347): n is a, c, g, or t
  misc_feature (2155677)..(2155964): n is a, c, g, or t
  misc_feature (2171579)..(2171585): n is a, c, g, or t
  misc_feature (2175830)..(2175871): n is a, c, g, or t
  misc_feature (2176265)..(2176304): n is a, c, g, or t
  misc_feature (2178078)..(2178095): n is a, c, g, or t
  misc_feature (2187425)..(2187455): n is a, c, g, or t
  misc_feature (2189730)..(2189848): n is a, c, g, or t
  misc_feature (2192846)..(2192868): n is a, c, g, or t
  misc_feature (2212942)..(2213033): n is a, c, g, or t
  misc_feature (2235965)..(2236052): n is a, c, g, or t
  misc_feature (2243161)..(2243179): n is a, c, g, or t
  misc_feature (2263478)..(2263522): n is a, c, g, or t
  misc_feature (2267220)..(2267328): n is a, c, g, or t
  misc_feature (2276660)..(2276715): n is a, c, g, or t
  misc_feature (2287146)..(2287152): n is a, c, g, or t
  misc_feature (2345090)..(2345649): n is a, c, g, or t
  misc_feature (2357328)..(2357373): n is a, c, g, or t
  misc_feature (2376402)..(2376411): n is a, c, g, or t
  misc_feature (2381944)..(2381955): n is a, c, g, or t
  misc_feature (2390830)..(2391015): n is a, c, g, or t
  misc_feature (2391289)..(2391306): n is a, c, g, or t
  misc_feature (2410422)..(2410441): n is a, c, g, or t
  misc_feature (2419482)..(2419570): n is a, c, g, or t
  misc_feature (2422343)..(2422343): n is a, c, g, or t
  misc_feature (2435615)..(2435662): n is a, c, g, or t
  misc_feature (2456922)..(2457747): n is a, c, g, or t
  misc_feature (2474588)..(2475507): n is a, c, g, or t
  misc_feature (2506175)..(2506262): n is a, c, g, or t
  misc_feature (2517106)..(2517198): n is a, c, g, or t
  misc_feature (2518104)..(2518116): n is a, c, g, or t
  misc_feature (2528188)..(2528214): n is a, c, g, or t
  misc_feature (2531018)..(2531037): n is a, c, g, or t
  misc_feature (2562484)..(2563070): n is a, c, g, or t
  misc_feature (2568701)..(2569063): n is a, c, g, or t
  misc_feature (2570803)..(2570981): n is a, c, g, or t
  misc_feature (2581385)..(2581451): n is a, c, g, or t
  misc_feature (2590156)..(2590201): n is a, c, g, or t
  misc_feature (2596267)..(2598202): n is a, c, g, or t
  misc_feature (2600669)..(2602678): n is a, c, g, or t
  misc_feature (2607869)..(2607899): n is a, c, g, or t
  misc_feature (2610826)..(2610862): n is a, c, g, or t
  misc_feature (2614863)..(2614916): n is a, c, g, or t
  misc_feature (2650440)..(2650449): n is a, c, g, or t
  misc_feature (2651618)..(2651779): n is a, c, g, or t
  misc_feature (2721656)..(2722154): n is a, c, g, or t
  misc_feature (2726572)..(2726591): n is a, c, g, or t
  misc_feature (2756677)..(2756935): n is a, c, g, or t
  misc_feature (2792873)..(2792896): n is a, c, g, or t
  misc_feature (2807915)..(2808338): n is a, c, g, or t
  misc_feature (2826420)..(2826420): n is a, c, g, or t
  misc_feature (2846813)..(2847051): n is a, c, g, or t
  misc_feature (2867603)..(2867632): n is a, c, g, or t
  misc_feature (2893808)..(2893817): n is a, c, g, or t
  misc_feature (2932428)..(2932450): n is a, c, g, or t
  misc_feature (2932898)..(2932907): n is a, c, g, or t
  misc_feature (2938766)..(2939057): n is a, c, g, or t
  misc_feature (2941823)..(2942532): n is a, c, g, or t
  misc_feature (2950226)..(2950241): n is a, c, g, or t
  misc_feature (2953111)..(2953176): n is a, c, g, or t
  misc_feature (2958923)..(2958932): n is a, c, g, or t
  misc_feature (2960866)..(2961341): n is a, c, g, or t
  misc_feature (3012176)..(3012261): n is a, c, g, or t
  misc_feature (3018590)..(3018599): n is a, c, g, or t
  misc_feature (3019719)..(3019728): n is a, c, g, or t
  misc_feature (3025496)..(3025864): n is a, c, g, or t
  misc_feature (3036540)..(3036573): n is a, c, g, or t
  misc_feature (3065156)..(3065186): n is a, c, g, or t
  misc_feature (3071916)..(3071978): n is a, c, g, or t
  misc_feature (3095034)..(3095064): n is a, c, g, or t
  misc_feature (3104147)..(3104147): n is a, c, g, or t
  misc_feature (3120981)..(3121001): n is a, c, g, or t
  misc_feature (3142568)..(3142709): n is a, c, g, or t
  misc_feature (3148760)..(3148769): n is a, c, g, or t
  misc_feature (3149358)..(3149367): n is a, c, g, or t
  misc_feature (3149649)..(3149658): n is a, c, g, or t
  misc_feature (3155233)..(3155258): n is a, c, g, or t
  misc_feature (3156477)..(3156523): n is a, c, g, or t
  misc_feature (3159331)..(3159991): n is a, c, g, or t
  misc_feature (3169595)..(3169610): n is a, c, g, or t
  misc_feature (3183460)..(3183480): n is a, c, g, or t
  misc_feature (3200946)..(3201081): n is a, c, g, or t
  misc_feature (3210157)..(3210234): n is a, c, g, or t
  misc_feature (3217649)..(3217676): n is a, c, g, or t
  misc_feature (3220511)..(3220544): n is a, c, g, or t
  misc_feature (3224601)..(3224610): n is a, c, g, or t
  misc_feature (3229181)..(3229195): n is a, c, g, or t
  misc_feature (3235058)..(3235067): n is a, c, g, or t
  misc_feature (3239465)..(3239474): n is a, c, g, or t
  misc_feature (3244829)..(3244829): n is a, c, g, or t
  misc_feature (3252926)..(3252964): n is a, c, g, or t
  misc_feature (3290805)..(3291255): n is a, c, g, or t
  misc_feature (3308222)..(3308292): n is a, c, g, or t
  misc_feature (3313993)..(3314121): n is a, c, g, or t
  misc_feature (3325901)..(3325902): n is a, c, g, or t
  misc_feature (3335916)..(3335944): n is a, c, g, or t
  misc_feature (3342039)..(3342390): n is a, c, g, or t
  misc_feature (3352510)..(3353389): n is a, c, g, or t
  misc_feature (3355039)..(3355304): n is a, c, g, or t
  misc_feature (3370197)..(3370643): n is a, c, g, or t
  misc_feature (3393034)..(3393092): n is a, c, g, or t
  misc_feature (3401495)..(3401772): n is a, c, g, or t
  misc_feature (3412111)..(3412126): n is a, c, g, or t
  misc_feature (3419076)..(3419085): n is a, c, g, or t
  misc_feature (3419746)..(3419755): n is a, c, g, or t
  misc_feature (3420030)..(3420030): n is a, c, g, or t
  misc_feature (3429459)..(3429488): n is a, c, g, or t
  misc_feature (3431080)..(3431124): n is a, c, g, or t
  misc_feature (3431278)..(3431370): n is a, c, g, or t
  misc_feature (3432701)..(3433528): n is a, c, g, or t
  misc_feature (3436779)..(3436925): n is a, c, g, or t
  misc_feature (3471234)..(3471240): n is a, c, g, or t
  misc_feature (3488619)..(3489261): n is a, c, g, or t
  misc_feature (3515313)..(3515917): n is a, c, g, or t
  misc_feature (3522216)..(3522221): n is a, c, g, or t
  misc_feature (3530326)..(3530334): n is a, c, g, or t
  misc_feature (3535697)..(3535706): n is a, c, g, or t
  misc_feature (3537255)..(3537264): n is a, c, g, or t
  misc_feature (3538136)..(3538168): n is a, c, g, or t
  misc_feature (3539057)..(3539066): n is a, c, g, or t
  misc_feature (3540399)..(3540408): n is a, c, g, or t
  misc_feature (3543259)..(3543309): n is a, c, g, or t
  misc_feature (3553047)..(3553056): n is a, c, g, or t
  misc_feature (3553487)..(3553496): n is a, c, g, or t
  misc_feature (3581365)..(3581839): n is a, c, g, or t
  misc_feature (3588142)..(3588438): n is a, c, g, or t
  misc_feature (3588750)..(3588759): n is a, c, g, or t
  misc_feature (3591533)..(3594001): n is a, c, g, or t
  misc_feature (3596109)..(3599392): n is a, c, g, or t
  misc_feature (3606330)..(3606330): n is a, c, g, or t
  misc_feature (3644831)..(3645061): n is a, c, g, or t
  misc_feature (3645485)..(3645509): n is a, c, g, or t
  misc_feature (3654623)..(3654691): n is a, c, g, or t
  misc_feature (3656462)..(3657069): n is a, c, g, or t
  misc_feature (3657920)..(3657951): n is a, c, g, or t
  misc_feature (3671223)..(3671870): n is a, c, g, or t
  misc_feature (3674839)..(3675292): n is a, c, g, or t
  misc_feature (3684335)..(3684505): n is a, c, g, or t
  misc_feature (3703509)..(3703515): n is a, c, g, or t
  misc_feature (3724792)..(3724888): n is a, c, g, or t
  misc_feature (3727684)..(3728128): n is a, c, g, or t
  misc_feature (3742979)..(3743028): n is a, c, g, or t
  misc_feature (3754680)..(3755028): n is a, c, g, or t
  misc_feature (3755588)..(3755614): n is a, c, g, or t
  misc_feature (3771912)..(3772653): n is a, c, g, or t
  misc_feature (3786498)..(3786549): n is a, c, g, or t
  misc_feature (3794344)..(3794422): n is a, c, g, or t
  misc_feature (3798602)..(3798689): n is a, c, g, or t
  misc_feature (3801512)..(3801521): n is a, c, g, or t
  misc_feature (3802226)..(3802235): n is a, c, g, or t
  misc_feature (3810008)..(3810055): n is a, c, g, or t
  misc_feature (3814900)..(3814909): n is a, c, g, or t
  misc_feature (3823984)..(3823988): n is a, c, g, or t
  misc_feature (3829287)..(3829307): n is a, c, g, or t
  misc_feature (3839943)..(3839983): n is a, c, g, or t
  misc_feature (3842551)..(3842578): n is a, c, g, or t
  misc_feature (3854214)..(3854222): n is a, c, g, or t
  misc_feature (3887018)..(3887053): n is a, c, g, or t
  misc_feature (3891580)..(3891627): n is a, c, g, or t
  misc_feature (3900277)..(3900311): n is a, c, g, or t
  misc_feature (3913165)..(3913219): n is a, c, g, or t
  misc_feature (3919545)..(3919564): n is a, c, g, or t
  misc_feature (3926496)..(3926537): n is a, c, g, or t
  misc_feature (3941369)..(3941378): n is a, c, g, or t
  misc_feature (3942594)..(3942595): n is a, c, g, or t
  misc_feature (3945320)..(3945337): n is a, c, g, or t
  misc_feature (3949616)..(3949827): n is a, c, g, or t
  misc_feature (3963575)..(3963652): n is a, c, g, or t
  misc_feature (3981315)..(3981347): n is a, c, g, or t
  misc_feature (3986872)..(3987487): n is a, c, g, or t
  misc_feature (3998695)..(3998704): n is a, c, g, or t
  misc_feature (4014387)..(4014493): n is a, c, g, or t
  misc_feature (4019717)..(4019726): n is a, c, g, or t
  misc_feature (4023761)..(4023957): n is a, c, g, or t
  misc_feature (4024420)..(4024429): n is a, c, g, or t
  misc_feature (4027779)..(4027803): n is a, c, g, or t
  misc_feature (4029858)..(4029867): n is a, c, g, or t
  misc_feature (4030298)..(4030307): n is a, c, g, or t
  misc_feature (4040939)..(4041055): n is a, c, g, or t
  misc_feature (4044001)..(4044064): n is a, c, g, or t
  misc_feature (4102687)..(4103494): n is a, c, g, or t
  misc_feature (4104766)..(4104919): n is a, c, g, or t
  misc_feature (4120963)..(4120972): n is a, c, g, or t
  misc_feature (4140259)..(4143474): n is a, c, g, or t
  misc_feature (4144398)..(4144624): n is a, c, g, or t
  misc_feature (4146575)..(4147468): n is a, c, g, or t
  misc_feature (4148876)..(4148910): n is a, c, g, or t
  misc_feature (4152282)..(4152408): n is a, c, g, or t
  misc_feature (4154367)..(4154565): n is a, c, g, or t
  misc_feature (4161765)..(4162130): n is a, c, g, or t
  misc_feature (4162414)..(4162452): n is a, c, g, or t
  misc_feature (4193279)..(4193344): n is a, c, g, or t
  misc_feature (4205279)..(4205462): n is a, c, g, or t
  misc_feature (4206601)..(4206653): n is a, c, g, or t
  misc_feature (4211545)..(4211587): n is a, c, g, or t
  misc_feature (4230131)..(4230290): n is a, c, g, or t
  misc_feature (4252364)..(4252393): n is a, c, g, or t
  misc_feature (4257018)..(4257036): n is a, c, g, or t
  misc_feature (4258027)..(4258415): n is a, c, g, or t
  misc_feature (4258726)..(4258735): n is a, c, g, or t
  misc_feature (4265632)..(4265736): n is a, c, g, or t
  misc_feature (4275273)..(4275353): n is a, c, g, or t
  misc_feature (4318756)..(4318759): n is a, c, g, or t
  misc_feature (4334118)..(4334177): n is a, c, g, or t
  misc_feature (4334486)..(4334495): n is a, c, g, or t
  misc_feature (4337677)..(4337731): n is a, c, g, or t
  misc_feature (4358160)..(4358188): n is a, c, g, or t
  misc_feature (4360127)..(4360892): n is a, c, g, or t
  misc_feature (4376213)..(4376228): n is a, c, g, or t
  misc_feature (4384066)..(4384079): n is a, c, g, or t
  misc_feature (4411019)..(4411028): n is a, c, g, or t
  misc_feature (4463655)..(4463859): n is a, c, g, or t
  misc_feature (4472337)..(4472355): n is a, c, g, or t
  misc_feature (4493576)..(4493577): n is a, c, g, or t
  misc_feature (4498577)..(4498598): n is a, c, g, or t
  misc_feature (4513388)..(4513629): n is a, c, g, or t
  misc_feature (4514807)..(4514958): n is a, c, g, or t
  misc_feature (4525086)..(4525088): n is a, c, g, or t
  misc_feature (4548808)..(4548808): n is a, c, g, or t
  misc_feature (4550273)..(4550280): n is a, c, g, or t
  misc_feature (4570864)..(4571163): n is a, c, g, or t
  misc_feature (4572318)..(4572594): n is a, c, g, or t
  misc_feature (4573573)..(4573582): n is a, c, g, or t
  misc_feature (4575000)..(4575639): n is a, c, g, or t
  misc_feature (4576953)..(4577896): n is a, c, g, or t
  misc_feature (4580942)..(4582083): n is a, c, g, or t
  misc_feature (4626218)..(4626237): n is a, c, g, or t
  misc_feature (4646190)..(4646199): n is a, c, g, or t
  misc_feature (4646952)..(4646961): n is a, c, g, or t
  misc_feature (4650725)..(4651237): n is a, c, g, or t
  misc_feature (4652125)..(4652242): n is a, c, g, or t
  misc_feature (4656407)..(4656416): n is a, c, g, or t
  misc_feature (4656803)..(4656812): n is a, c, g, or t
  misc_feature (4662728)..(4662931): n is a, c, g, or t
  misc_feature (4665045)..(4666240): n is a, c, g, or t
  misc_feature (4690300)..(4690309): n is a, c, g, or t
  misc_feature (4690683)..(4690793): n is a, c, g, or t
  misc_feature (4691405)..(4691450): n is a, c, g, or t
  misc_feature (4700790)..(4700820): n is a, c, g, or t
  misc_feature (4711202)..(4711292): n is a, c, g, or t
  misc_feature (4712769)..(4712820): n is a, c, g, or t
  misc_feature (4722142)..(4722299): n is a, c, g, or t
  misc_feature (4732441)..(4732500): n is a, c, g, or t
  misc_feature (4737582)..(4737591): n is a, c, g, or t
  misc_feature (4744644)..(4744666): n is a, c, g, or t
  misc_feature (4756128)..(4756180): n is a, c, g, or t
  misc_feature (4757488)..(4757573): n is a, c, g, or t
  misc_feature (4761730)..(4761850): n is a, c, g, or t
  misc_feature (4762546)..(4762555): n is a, c, g, or t
  misc_feature (4767004)..(4767068): n is a, c, g, or t
  misc_feature (4773375)..(4773402): n is a, c, g, or t
  misc_feature (4780534)..(4780543): n is a, c, g, or t
  misc_feature (4787557)..(4787592): n is a, c, g, or t
  misc_feature (4798587)..(4798620): n is a, c, g, or t
  misc_feature (4804390)..(4804399): n is a, c, g, or t
  misc_feature (4809182)..(4809204): n is a, c, g, or t
  misc_feature (4814770)..(4815013): n is a, c, g, or t
  misc_feature (4828496)..(4828511): n is a, c, g, or t
  misc_feature (4863380)..(4863395): n is a, c, g, or t
  misc_feature (4876042)..(4876085): n is a, c, g, or t
  misc_feature (4892217)..(4892249): n is a, c, g, or t
  misc_feature (4911288)..(4911665): n is a, c, g, or t
  misc_feature (4934293)..(4934445): n is a, c, g, or t
  misc_feature (4955852)..(4955871): n is a, c, g, or t
  misc_feature (4962361)..(4964733): n is a, c, g, or t
  misc_feature (4972719)..(4973812): n is a, c, g, or t
  misc_feature (5043041)..(5043629): n is a, c, g, or t
  misc_feature (5054246)..(5056903): n is a, c, g, or t
  misc_feature (5089557)..(5089769): n is a, c, g, or t
  misc_feature (5103796)..(5103803): n is a, c, g, or t
  misc_feature (5115447)..(5115587): n is a, c, g, or t
  misc_feature (5162876)..(5163259): n is a, c, g, or t
gcatcatgattaatggttccctggctactccatgttgaaggttcttaaaatcacctccagcaggcatatattgtgcttcggacttagcaggtgggggtgacatttgcaacggtgatgccagtgaataagaaacggaaggattagatcctgcacttggccaccttttatcagctggtacagtagcctgctggggctttgcccattcagacttaggttggattctccttagaggttgcatatttctattactagaatctgaagatactccaatcgtcaatgcagcctttgtatagttaaaatccttgtcatcttttttgggttgatttggtaaaggaacaggttttgtttgtggcattgagctctgacttgcaactcttgactgcttaacattgttaataataggaggatcgccggtttcctctggttttggtggagcagatggtggatcaagtttcaagtctctcaaggtctttgcagccctatcaagatcaccctcacagttaacaatcactctttcgacctcctgttttgagcaatcatacctggttaccatatctgcaatccgagcaagctcacctgatatgtcaattttcaaattgcccctatttatgtttgtatccttcttaacatctgcatcttcaccaccttcaaacaaccacgctactgattcctccaccctaccttcatttaatatcagtgccattgttgccctttcatgagaaaatcccattgccacaagctgttgagaaagtgcctcaagtttccttgacataagataaccagtacacctctcatgcaactcctgtgctcgcctttccttctgccgttgatgttttctctcattcttctggcggattttctctcgcttgtcattatcagctcctggtactgattcaggtcgaacagaaacattagaacttttctccttatgttcttcggactcaccagaccaactaccattgttagaaacagaatcatactcaacaccagcaaccactgagctgacaggatgttcatctatctcatctatgttctgaaaacgaccattcgaatgtattggtgaggtaggtgttggtgacatgtccacagtatggaatgttcctaataaggggttatatgcactggctggcacaccagctgctgcattaccagatcctgtaggctttgcagaagccttctgagcttccttgcaaggcttcctgtctttagacttggatcgggatgcaggagacatccttaagagtcaatggccctgtaacattaaaagaaaacaagttatagtacattgcattttaattaccaaatcaatacaggattacatgcatcacaaacctattgaccaaataatattctgttcaatcgccaaccccccnnnnnnnnnntttcgtcttcatgtattgattcaaacatattttatgaaataaaaataacataaacttgtgaatattaagagcgaagaagacatatataaagaaagactgcacaagctaatgtagaaaaataagagtatttgaaagcattttttttatggaaaagaaaggtcgttcagattttgaagaatatagaagcaaacggtgatttgaaatattgtgcctagttcagtttttaaatcttttcagaaacatatttaaatatgaaaatatataaannnnnnnnnnaaaaaaaaaaaaaaaaaaaacatagctttatttggttaatcatatatgttacatcatatgttttttgtttatacaattacaaaaatgaaaaaagagtggaaaagtgaaatttttgtatacacaaaataaaaaaatacataaaagtagagaacatacctttatttagtgaatcaagcacgttgtatttaattttttttatacactaacaaaaatgtaaaaaaaaaatccacatagtaaaagtaaagaattttttatacgaaaaaacaaaaagacnnnnnnnnnnagagacaaatgaacaaaggcaaaaagaaagtgaacaagccaaaaaacaagtacatgttaaaataattaaacaaaaaccaaacagtttatcttccccctataaagaatttttaataaaaatcattgaggaatataggaagaggggaaggatttcatgtccatacactttaatacattttaaaaagagaattttatcacagaggaacttttttaccaatgatgtctaaacttcatttatatgtgcggaaccagaaatttatataattaaacaaccaatctgacagcaaaaagcaagatccctctcggaatggcacagtatcaaaattgaaaatatttcagttgaatttaccagaagaatgcacaacacttattaaaaagacaatggagagtgcaagtatcatacagtccagtatcacctttcacagaagttcagctattcaatggcgccgatattttcaaacagtcaaccgtaagacaaaaataaaacaccattccatgttctccagtcctccaccattccagttatacattaatcaacacagtaaataaaagaaaaaaaaaaaaggaagttgattttcatattcctcaaaggccgtgacatgattgatgatgactcccccaaattttcacacgatcaccccacccctaacaaaaatccaaattcttgtgaaccaaccatgaccccacaatcccccataaaactgatatgtgatatgtctattcaaacatccaaaaaattccactttctggcaaaaaaaatattccccaatggccactcaatacaaaaaatctataatcacacacatcctattcaaaattatatatatatatatatatatatatatatataaacgcaatcaaggtcaaaattacaaggatcagcacactattccctctcgaggatccgtgatatgcatgcttccccaatccaaagagacccgaaatccccaaataccacaaaaggcaaaaatgcggaattcgaattaccgaattccgcgattgcacaaaacgcgaaaccaaacacgcagtttcttagtccccgacacaacaacaaagaggcgaattaccgaattccgcgagagaggatcatagctgcggtttgagattgaaagaaagagagagaaaaatcgaaaaatgggaacacgaagaagaaccaacctggggtttcggaaatgggagcgttgatgacgatgatggcgacggaaggatcgctgttgaatgccgaaatcgttggagagagagagagagagagagagagagagagagagagagagagagagagaacgaagatagagaaaaagagagagaggtttttcgaggctcaaactgaatttggcagaattagggttttgaagaaacagagatcttataaaagataaaaacaacgacattaatttttataaaaaaaattaacttatagagtaaaatagttaattttaattgttcatataagaaaattaatcaatctataaatgtttttaagattttttattaaaaatataaaactttttttttaataaagaaaacctatccaaatagactttagtataagtagtatttatatattgacttttaaggaaactaaactaactaagagctatgtgcaaatttaccgaattcaaaagtttcaaactgagccaatttgcaataaaaaaacaggagcaactttttcctattcaaaattattttgccttagactacacatataagattctattattgtatatatattggatatacgcaaaaacaaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttttttttttttttttcacaacatgaggaagaagctagatactcgtttccctgcggtaaagtttctctttccctttgcttttgttttcttttttcatgtagaaaatattgttccttgttgttttgcattctattcattgtgagtttatgtttgctatttttttgtgtcattgggtttgttgttttttgttttccttgtgtaaattgatgtttctgactaacatgggagatgggtttctcttggttttggaatctctgatagttatgtttgtgcaaacgtgctttgtattaacatgtgaggctttggaattgttgttacgataaatttttttgccatgaattgttgactttgttaatgaattagatgttaaagttaatgtttttctggtcaatattgttataggcccataggatgttgttaatttgatgaaataagttttctttctgaaagagaaagaaggatggggagcctgctgttgaattttaatgtagtgcaacatatttaatcagaaaggaaacaaatgttttgaagttgtgattggcgcatatcttaaatctttttttattatgtgtatgtcttaacttggagattttgttggtataatttcatttttcgtttttatgtctacgtagtttggaaatagtagttgtcttgtaaagcatccgcatgctttggtttggctgtggaatatcaattaccgattttggaatgtaaaacattataggtggtttggcatagctttaggtcaggctttgtgtattgtaagctaggacagcatgttgtgtatagtactgtggtatggtgtgatatattccccttctaactttttctaaatttggtattttgtatcttttttaaaaatcccctgaatttggtcctgttgggtcggtaaccctatctatttgcggaagcgaagtaaatctgtgatgagatgggaaaatatagaagcagaaaaatatcacccagagaacacaaaacaattttaacgtggaaaacctcctcaatgtgaagagtaaaactacgggacactagtccagaaaaacatccactatgaaagtaggattacaaagatgatctctctagtaagactagaggtatacactcaaaatatatatctcacccactaaggatggcttacaaattttatctctcactgggaggatttatctctcacctatatggtggaagtctctctttctctacaaagaggaacactctcactctcttcaaagaggaactctcttactctcttcaaagaggaattctctcacccacacaactcttcttcaatgctttgaagaatgcttcaattttgggatgatgaaaccattggcaatgttgtcaatttatagcctcaagatggcttacctaccacaccaaccaaggatgcacacctactacacctactacaccaaccaaggattctcacctactacacctactacaccaaccaactaattctaccaactcttaattaaagaagaaatagtccaacaggtccctctcaaacaatggtattttttgcggtgttggttggccactacctgtcctgtagatatattttagaaatgatactttagatagatgaggacgaaccctgacacaacggtaaagttgagccttggtgactttgttggtcatgagtttgaatccagaaaaacctctttgcatatgcaagggtaaggttgtgtacaatatccttcccccttatcttcgcatagcaaagagtctctgggaaatggagtacgtggttttttttatactttagatagatgtaaagttaagcaaatttatttgtaagccatttggtttgcaaaattacttccaattctggattttattctttgaccttctgagaagggattgtttattccttttttaaaactactgcttccaagtatttccatattataatcctggaggatagcatatcacacgtgctcaaacagaattatacaacaacaacaaaaactcttttcccactaggtgggctggaatatatggaccaaacaatgccaccatgtcctattataaatcatgtccataggttaatcatttaaatacaaatatagtttttgttggtctctctctatctctaactatgggactacccatcatctgttgttcagattctatagtttttctccatacatacctaagccttgttcatgtgggaaatagacacaagggtcttctgtcgcacaccttgtattcttacacttttgaccccattgtacatgtacttcattgcttgaatatagacaatatacctttctgtctccacagccttgcacaatacacgcatatcttttatacttttatttttaggaggagaatgagtagtggaatttgagcatagatttctggtggagtaggacaaacactcagttttttcctttaacttatagttgaaaatttatttctttcttcatttattgcagtggaatttccttaattgcattaaattagaatcctcttctgccaacatgatttagttttagacattttaagtaatgattgagtaatcttattgaattgattattggcaggctaggattaagaaaattatgcaagctgacgaggatgtagggaagattgcaatggctgtgcctcttctagtttgtaagtagcctttctctttcatgcatattcttgggtgttttcttcttctcttgaaaaatgatttttttttttattgtgcttttgggagtttctatgaattatctctgatttatgattatttgtgtttatgtattgcagctaaagcactagagctatttctgcaagatttgtgtgatcgaacatatgagataactttgaggaggggggcaaagactatgaatgcttttcatttgtaagtgaagtttctattattttcttggttcaaatttgtgtctatgtcaagtctgttcaagttggtcacaaggctgcaggattctttcctttggagggcggttattactatgtacttataagaacatcagatctgcaattctaatgataatgtgctcggtatcaaacaatttccctcttgttccttctatttatcacatgcacaaacatgattagacatgtaaatgacatctgcagaaacaaatgttgggatggtcggtcttgtttttggaacatgttttcgttctactgttttaccttcactttccagtttctaaaatgtctgagttacttgcatccttgcctttgcagaaaccagtgtgtgcagacttttcatgtctttgattttctgaaagatattgtcagcaaggttcctgatttaggcggttctgttgcaactggtgatgaccatgttgtcactaagaggaggtttgtgctctggttaatactctttttacttggaacaagttttctgtatgctgaactttgtttactttatattaggaaagttgccggagatgatgataatgacagcgacgaggagctcaagagaaataagaaggtaatttataaactgtattcaattacttcatcagtggttagcttaaattttcttgtctgattgaaccttttgctgagtaattatctcttgtccatgcacactgtgaaccttttcctggatacaaaaaaatttacttcagtcaatagggaaactcactagtggcttgtgaatgcaagtacgtctaaatgtctaatagtctgtgtggctaggccccacttcaccttaaagcttactacacaaaggaccaaaactgtctggttttctgaaaatttttgctgaaaactatagaattggctctaaagaacctggcagctgtttaatattaaatattatctgaattatggaactttttttttttcttccatgatttgcacagccagagcctggacataacagtagcagaggaaggggtaggggcagaggtaggggtacggggccgtggaattagaactgtagatcaagagatgagttcacatgccaaatgggaagatgattctgatgtattgaagcagaatgacaaccacactcaaagcaatgaaagcatggaaaatgtgccggaacctgaagtagttgagcaaaattttccagtaagcaaaccggctgaagtgtccattctaaattttgacttaaatttggacccagatgaggatatggattcattagacacaccaacttctgtcccaactagttcatctgcagaatcagtgtcagaagagaagaatgaggaaccctggatggtccttgtctgaaatggaaagaatgaccattgatcccattcaactagccaacataaatggaaggattgatgaagatgaagaggattatgatgaagaaatgtagatgaacctgtgttggtttattcattacttctcatataggcccgtcattagaatgttcttatgggaaattagagtagattttgtaggagcagtgttagatagatacttactcctttgtagtttaggaagattaggagggatagggcattgaatactctccttataacccttgttttaggttaaagtggagatatagattgttccaattagaaatagccatttgccagtatagttatgacttatgagaaattttaatctcttgtaggtattgcttatggtagctagacactacattcagattttgggtgttttatggctcaaaattttactgggatgcctatcttaatcacacttgtatctagcggaactaactcactgctccggcaacatgatttgcatgcaaccgtttgaatttttgttatcttgaacttattgcacgatgagacaagaggcgaagaataagacgttaggcggatggaaataaatacgaaataaactaaaaaagatgtgttatttagatgaataaaaatagaaaggaaataagtgtaaaaattcattatttatgtttgttttggacaaatgaaagagaaaatacaaacaaatgaattgtttgaaaaaaatatatatacatttttttaaaattatttccattattttctaacataagatcattattttttattatataatatacttatttgatttttaatatataagcatcactaataaaaccaatctcgcctcaaagtaatttgtttaaacttaaaataagtatttttaaaataagtaatttttaaataagcatttatttaataaacaaataaagttgatcaaaataggcagaaaaaatatttttttaagcataaacataaagaatgatttgaataattaactactcaatgtgggacttgtgcctaccatgaggtgaacgttatctaaggtggaacataaaagaatgttgttatggttttaaatctacttggaatactaataagagagaggtgaaactaaaattccaaattatagttaacttagtcctagctctagatccacatgctacatgcctccgtccctgattggagatatatatgaagtttatatttaatatggataagtcctaggaaacacagaatagccggggctcaatcttaaagtttagaataactataatttcttattaaaatgccaatcgaaatggttcttaacataataacagtggttgtgacatatagttgctcccttcaccaaccacagggaaaaccccaattgaaaagccattgcataagaaatccagttggaagtgtgatcaaatatcagaatggaagctgcagtaaactcgctttctgcaaatcttatgaagtgaaatttgacaagaatgagagtatagacgcagaagaagtcaataatgcagtagggcagccaagtgcagtacgttccatccattgtcggggtcccttatcatggtcactagttcactattatcgtcaagaatccaacatcatttttttgacacacgcacataattaaataaataaataaaacaccatttgcaaccgatcatgaaagcttacttagaatttctgaaggctttcgcgccagcatatgcaatgctgttaacttctctttttgcctcttcatctcttgcaatggccaaataagttggttattttttaaataatttcattgccatttgccacatctctgttacatgcacaaattaaatagcgatggtggattgcatatgtacaaggctaggtaaatctccaactaaattcaaaaaccaagtacgagttcaactagataaaaaaaaaaaaaggatgtttggctttacacttaccaaacatgttgctgctaacggtcataaaaagcagtcgttgaatatccttataagccattttgtgaagcagattctgaaaggacaaaatttgcaccattttgttgtacatggccatataatacaaccaagcgaactggaagcatcccatctgagtttggtatcagcctagaacgattggatctgcaattctaatgatactgtgctcagtctcattaaatttccctcttttgccttctatttttcacatgcacaaacatgattagacgtgtaaatgacatctacagaagaaaattaaatgttggaatggtcttacttttggaacatgtgttgtttgttctattgtttaccttcactttctagtttctaaatgacatctatatatctatatatgcactaacaatataaaatgattttatataaattatcattttaaaaatcaataaatttattatatataataagttattgattatgtaaatgtttttacactcttaatacataactcttatctataaataaacaaaaataagatgaaaatgatgtattatttagaggaatagaaataaaaagaaaaaaaatataaattttaatttgtttgaataaataagagggtagaaaacaaaaatatgttcattgcaaaaatgttcatacaaataaaaaatcaaatttaatttgaaaaatccgacctttttatttcattatttctcaactcaaaaatactttgttataaaaagataatttgattttttaagatttaaacataagtaaaagaacggcaaaccatttctccctccatttcacatctcttagtgagaaatatggtttgtttaggactcattaattataatttcatttctcattttctaacacattcaatcaagaatattttttttattacattatttctcttcattttaattttatatttattataattttgttgtatatagtaattcttgtcaaatcgagtaagatgaagtctcactgaaaaatgaatgtgtaatgaaaaaaaaaaaaaaaagctttttctgtgttatgatttgctcccttcaccaaccacatgcatggaaggaaggggaaaagctttgacgtgggttatgcagtgtagtctcaaattaaggcgggaacaataagaaaggtaatatttcatgacatagaaaatgtagaataatctcaaatttaatacatgacatagaaaatgttccacatagaaataataatacagtgccttaaagtcatgccaatgtctgtaactctgtaataagatagtccagttaggacaaacgataatatctggaccacaagtgtttatcgaaaaagttaaattgaaagagaagaaacagaagtattgggaaaacccccattgaagtcactgcataagaaacccacttggaagtgtgatcaaatatcaaaaaggaggctgcagtgaaagccacaaccatagcagcaacggagataataagtaaccaacggccaaaagtcaagctgggatgtagtgatatcacaaattcgctttgtgcgaatcttgatgaagtgaaatttgacaagaatgagagtaaagatgcagaagaagcgaataatgcgactgcatttgtcaatatgaagacaggaaaccacgcattggtcttagcacctggaacagtcagagcagccgcaaatgctacggtagcaacaagtgttgacacaagcatgccagattcggctattcctttggctgtttccttaatttcttcagataacttcttgtgttcttcagaaaatacatcaattggtgtcttgcccatgttgtttctcattgttcttagttcacccagaacattcgactccacgaactatttacaaatcaagagaatatgtaaatgatggtatccaaatgcataatttaattaatctttcaattatcacttaattaataactagagcaaattacagcaatgcctcctaaattcagtgtagttacacaaatatattctcaggtataagcttaaaatttgaagaaatgttagcgtaatattttcaaacttataagaaatgttagtgtaatttttcaaacttaaaaggaattggtataagaaaaaaaaatggaattacatataactacacgtaactcgaggagaattattgtaatttgttctaataactattagatattaaatttgtaagaaatacaatttcaaagttaagatactttaaaaataaatcttacaggtgatatttattgttacaaatgcacgtgtataatttttaattaaaattttctatccatatattggctgtttaactattatgctaaagacaatggataacaaattttaaaaaattattacaataatcaacaaatgctacatataatgatttctatttttaattaaaacttgttacttttaaagatttaaaatcagtctagttaacaaaagcctaaaatttgtggaattgttaaattaagattgctagaactgatggatcccatgcgagtgaataaagaattgttgaataagagaaactaagcaaattaattgaccttgaaccatgctagctctctttgcatttgaatgcgtgctcttaaactggacaaatcttcgaattcaactggtggaagatgcgcagccaagtgtagaatgttgttaccttcattgtccacttctcgtactttatgctcttttaatgtccatggtatactattaaatattcttttttgtcgaaatagcacaaccaagtgcagcaggttccgtccatttttggggtccttaaattcacgattcatgtcaatcatcatcttcacaacctcaacacatcctgattttactgcatgaaacagcactggcgaataataagtagatatcaagtactcctttatattccaattacattggttaacttgagtcaatatttttgtaaatagccgaccagcttttgagtccttgtcctccatgtctagcaagcggtatatatatatatatagtttattggtccaaccaatgtttaacatgaaatgaaacaaacaaaagttagattaaaattttattcttatatatatgaagcacaatttttttatctctatttaaaaaattatatttttaatccgtacatgaaaaaaaattgtaagatatttttacacatgtgactcgtgtgttggcaaacattaatttgtgttattagaataactcaacaaacatcaaataccattattacactagatatcgatgattaaggactaattcttaattttttatataaaacaaaaatatatataactttccaaaataagaatcaaaatggaaatgatgtcaaataaaatctaaattttagcttagcgcgcgcacacacaaaaaaaaaaaaagccattttcaacttgtgaaagcttacctaaaatttctggaagcgcttgctccagcataatatccaatgctgtaaagtctctttcattttttgcaatgaccagagtagttggatgtttttcaaataatcgaattgccaaatctgttatatgcacaaattaaatagtacaaggcaaggtaaagctccaactaaattgaaaaaccacgtacgagttcatatatatttccttttatatatatgaaatcaaagagaatatagctaggacctgtttggttttaaaggatgatatcacagactttcagaaacctaataatcataattaattatttcaacaatttgaattatggtcaattattgtaccgaataacgttggaattgtatatataaaagagaactatattaaaaaaaggagaaagaaggttgtttaattagttttacacttaccaaacatgtcgaacccaatggtcatgaaaaacagtcgttcaatatccttgaactccattttgtcaagcactttctgagaggacaaaatgtccactattgatctgtccttgagacgacgatgtttaccatatgaagctgcagccaagtgaactggaagcatcccatctgagtttggtattagcatctcttctggcctcatacgcttaaccaactcattcacaatttcaaacctgtcttttcttactgctagatgaagagctgtgtctccacttgagtttcgtattagcatgttttctggcctcatacggttaaccaactctttcacaatttcaagactgccttgccttgctgctagatgaagagctgtgtttccatctaagtttggtattagcatgtcttctggcctcatacggttaaccaactctttcacaatttcaagactgccttcccttgctgctagatgaagagctgtgtttccatctgagtttggtattagcatgtcttctggcctcatacggttaaccaactctttcacaatttcaagactgccttgccttgctgctagatgaagagctgtgtttccatctgagtttggtattagcatgtcttctggcctcatacggttaaccaactctttcacaatttcaagcctgtcgtaacgtactgctagatgaagagctgtgtctccatatgagttttgtattagcatgtcttctggcnnnnnnnnnnggttaaccaactctttcacaatttcaagactgccttcccttgctgctagatgaagagctgtgtctccactatcatctaacggaatgcgtaccatatcaggatattcatcaataatcgattttgatttgagccactcatcaccacaccatatacgcttgcacagatgttcttttaaagaacctacaatcctttcaaacttcacattataacatgtcctttatataataatcataacttttactatttagttgcaaagaagaccctttaaatttctcgtttaccctaaatctgtaaaacttctcttgtctcaaattttgaattcctaataatttcatcatttgtaaattgaaatctagctgagaaattcgagattatgtagtnnnnnnnnnnnnnnnnnnnnnnntttttatactagttatagtcaactatgccaacaaccattgaattacaagatgcattttattatcggaaaatgtatgaattttattaaacccactaaaacaaccattgaattcaaggcaagactagaaaaaaaatacttatttaatattttggtgaaatttattcagccagtcatattaatatatagttatttttgataatttaatccttttatgttgcataatataaattcttttattaataataataaacaaaaattaacaaataaataaatttgtcacatttttttctttcaataatttaaattttcttatttaaaaataaatttatcaatgaaaaataaaaataattatttattctaacatatttataatgtttagaaacatgtaggctacgatggaagaggataaacggtctctcatcttaagaaagtattttatgaccatcagattattttgtttaaaaatcaatgatcgtaaattttttttcttttattaatttttttcttttttttgtcctctttcccgtactacctttttcctctttcttcttatcttctttcccattcttcctctcttcgtcttagcggcaacgtggtgccatgacagccggtgatagtggggatgttaatgcgtcgttgcctggtcgttgtgcggaataaactagagagaactcgagagtgtctttcgccgtttttcttgctgtgttctgcaacaagatttcaaccggagaaaaagaggtaatataatatagtagatagtagattttgcatgtttagttattttagcataatcaattttaattgaaaaaaattatatatgatggagttgaagtagnnnnnnnnnngttaaccaactctttcacaatttcaagactgccttcccttgctgctagatgaagagctgtgtctccactatcatctaacggaatgcgtaccatatcaggatattcatcaataatcgattttgatttgagccactcatcaccacaccatatacgcttgcacagatgttcttttaaagaacctacaatcctttcaaacttcacattataacatgtcctttatataataatcataacttttactatttagttgcaaagaagaccctttaaatttctcgtttaccctaaatctgtaaaacttctcttgtctcaaattttgaattcctaataatttcatcatttgtaaattgaaatctagctgagaaattcgagattatgtagtagtcgaagggatccaatcatcaatcacttttaattaagtttgaaaattgaatttcaattttgtgtttgaaaattaactctatgatgataagtaaaattgtttttgagagaagtaatttattttttcttttcttcagttgacaaaagctaattgatcttaacatgcgacttatacatatttatactcatactttaaaagtgattttacttttctttttttatctttcgaataaaaaataattttctaaacccattgttgaaatgtaaaataaacaaactcttaagacatgatctctgaaatgcaacctcttttgaatgcaatagtttaaagtataacttactcagctcttctggagtcatttgattcactcctctgctttcatgttttgttgtcggtgagtttgttgaagtggcaattggagtttcctcatgactttgattaggagtatgatctggtggaatctgaattatgtggtcatctgaaacttcgttattggagttcatgatttaattctagggaaaatcaagtgatttggatacctctctaaaattccctgtgttacttctttccagcctgagaagcttaacatattatatatggtggtaaaacaagagccctcaattaattatttttccaacttgcacttaaaataactatttccaattaatatgacattttgtggattacagctagcaatgttaattgaatctgttcaacatttcaaccccacagttttcaaaagctttttaagttgaatgatttttaaatttatataatattaattcatttttaaagtgaataaatatattcattaaatttgttaaaagaaaaaaaattcattatattttgtacattagcgagattcgctatcatgacactgttaattaacttactcttaatttaattaatattatcttcttcattgtacaatgatatgatagtggtagttatatatttattatatatttcctttgaggcatttaattctatgattatttatccaacacaatttttataaagtttaggaagagacaggctagaatgggagagtgtaattactctcaatttaatataatttttcttccttagacaatggtataatatctaaatattttgaatttaagatttgatttttattaaatctttcaataaatgagctgaacaaatctttaatatggagaatgagtttttgaagaagaatctttaatttaatgttaaaaaaagaataatttttttcgtctctctcccctaatatatcaaaatgagatctaccattaaagaaaaaaaaatgaaagagatattgagagatttttaatcttatgtaacactatagagtctaccaaaaagtggtctaagatcccaatttgcgatcttccactaaagatgagcaatgatattgagcttaagatgtggtcttcactagattttccaataaatgaggtgaacataactccacaatgaaaaataaatctttgtagaagaacccttaagatctacacaatattaaaaaaataatttttcccacactctctcactaatatttcaaaatgagatttaccactaaaaaaaatggaagagatcttcaatcttacttggcactatataatctactaagaagtggtctaagatcccaatttgggatctaccactaaagatgtaagcatctttaatgctaaatcttaagcaaggatcttaaacttaagatctgatcttcactagatctttcaataaaagaggtgaacaaatttctaagcatgaagaatgaattcttgtggaagaaccctgaatatttgcacaatattcaaaaaagaataattttgtatcccctcttttctcctaagatttgaaaatgagatctattaagaaaaaaatgaagagatcttcataaatatttaatcatatgtgatactataggtccaccaaaaagcaatctaagagcatatttagtgtaggattaaatatttcttccatttttattttagtgataaatctcattttgagatattaagagagtgagaaaaaattatttttttctgaatattatgcatattttaaagattcttctaaataattcattatttatattaaagatctatttacttcttttattagaagatctagtaaagattaaattttgaactcaaaatttttagtcaagatatttcaattaaaaatctactattaaaatgcttattattgacgaaaactttctgtcatagctgtggttatatacttatctacattccgttgtcgcatttaattcttggattatatcctaagtatggtctttttatactagttatagtcaactatgccaacagtcattgagttacaaggtttattttattatcggaaaatgtatgaattttattaaacccactacaacaaccattgaattcaacgcaagactagaaaaaaaaatacttatttaatattttggtgaaatttattcagccagtcatattaatagttattcttgacattttaatccttatgttacgtaatataaattcttttattaataataaaaaacaaaaattaacaaataaataaatttgtcacttttttttttcaataatttaattttttatttaaaaaatatatttatcaatgatctatatatttaaaagataaaaataattatttattataacatattttataatgtttagaaagatgtggcctatgatggaagaggataaagagtctctcatcctaagaaagtattttatgatcatcagattattttgtttaaaaatcaatgacactaaaatttttcttcttttattaatttttttcttttttttgtccttctctttcctgtactacccttttcctcttcttctcttctttcacattcttcctctcttcgtcttagtggcaacggtggtgccatgacggtcggtgatagtggggatgttaatgcgtcgttgtctggtcgttgtgcggactaaactagagaaaactcgagaggatctttcgccgtttttcttgcggtgttctgcaacaagatttcaaccggagaaaaagcatggaagacgaaacagtcacaaagctttatataactattgcctcacttaaacccaaattggattcaattgaccagatttttgtctcccaaagttttgagctttttgatatttattgtgtacgtgttgattttttctcatgggtgccaagttacgagtttgtttcttgcataaacgttgtttctataccattttactctcaattttgagtccaatttgggagaataaaagacctaaggttttggttctgaaaatcagatgacattttttatgacgattttgtgattatatttgaaattgcagtttcaaggaaattattgtaccattgttctgtaatatttgtaatctggccttgttttctatgttcatatatgtgatgggtggtagtggctccgttgccgaaaattgctttctgcgtaggtgtcgttgctgaaaattctagtatatatgaaaaatgttagtaatacattttaaatatgattttttttctattgattgaaattcttttaaatttcaaaattttgtaaatcttacatcttatttaatgaatttatttatgattttggagcatttaataaattctaataataataataataattaataattattattttgacatgaatatgttccttaaattaagtagctcattccttaacaagaatttatagattttatgttagttctcagtgggtaacgggtaataattagccatttgttgtctttcggcggcagccatataatatgttcaaaatccgtgggatcaagtaagcatgaaccttcctttcttacatgttcctccacttccaacttataataataaacacacacaatgttaataattattaataaattgtgtggattagcgagactcgctatcatggcactatgttaattaacttttcttcgttgtacaatgatatgatatctttacacacctaaaaccttcaatttcctactcttacatcgttgacgaaaactttctgccatagcggtggttatatatttatccaacttccgttgacgcatttaattatatgattaatcctaactctggtctttttatactagttataatcaattactccaacaaccattgaactcaaagctaagactagattcattttattatcggaatatgtataaatttattaaactcactccaacaaccattgaattcaaagcaagactaaaagatagttacccacattttgattgttatgttggtaattgttgttcttgcacagtgttaaaaaaaatattttttttttatctctctcccctaatatctcaaaatgaaatttatcactaaagaaaaaaatagaagagatattaagagattttcaatcttatgtgacactatggagtctaccaaaaagtggtttaagatctcaatttgggatcttccactaaagatgagcaatgatattgagcttaagatctggtcttcactagattttccaataaaggaggtgaacagaactccaacatgaagaataaatttttgtagaagaacccttaagatctatacaatgttaaaaaaaataattttcccccctctctctcactaatatttcaaaatgagatttaccactaaaaaaatggaagagatcttcaatcttacttcacactatatagtctactaagaagtggtctaagatcccaatttgggatctactactaatgatgtaagcatctttagtgctagatcttaaggaaaaatcttaaactcaagatctgatcttcactagatcttctaataaaagaggcgaacaaatctcaaagtatgaagaataagttcttgtggaagaaccctgaagatctacacaatattaaaaaagaataatttttatcatctctttccctctaagattttaaaatgaaatcaattaagaaaaaaaaatgaagagatcttcataaatatttaatcatatgtgatattacgggtccattaaaaagcgacctaagagcatatttaatggtagatcctaaattgtgatatttagaccactttttgatagatctcatagtgtcacgtaagattaaatatctcttccatttttttaatgataaatctcattttgagatatcagggagaatggaaaaaaaattaatctttttaaatattgtgcatattttaaggattcttttataataatttattatttatattaaagatctttttactccctttattaaaagatctaataaatgtcagattttgaactcaaaattctttacttaggatatctcaattaaaaaactactattcaaatgcttattattgacgaaaactttctgccatagctgtggttatatatttatctaccttccgtttgtcgcatttaattcttggattatatcctaagtctggtctttttatactagttatagtcaactatgccaacaaccattgaattacaagatgcattttattatcggaaaatgtatgaattttattaaacccactaaaacaaccattgaattcaaggcaagactagaaaaaaaatacttatttaatattttggtgaaatttattcagccagtcatattaatatatagttatttttgataatttaatccttttatgttgcataatataaattcttttattaataataataaacaaaaattaacaaataaataaatttgtcacatttttttctttcaataatttaaattttcttatttaaaaataaatttatcaatgaaaaataaaaataattatttattctaacatatttataatgtttagaaacatgtaggctacgatggaagaggataaacggtctctcatcttaagaaagtattttatgaccatcagattattttgtttaaaaatcaatgatcgtaaattttttttcttttattaatttttttcttttttttgtcctctttcccgtactacctttttcctctttcttcttatcttctttcccattcttcctctcttcgtcttagcggcaacgtggtgccatgacagccggtgatagtggggatgttaatgcgtcgttgcctggtcgttgtgcggaataaactagagagaactcgagagtgtctttcgccgtttttcttgctgtgttctgcaacaagatttcaaccggagaaaaagaggtaatataatatagtagatagtagattttgcatgtttagttattttagcataatcaattttaattgaaaaaaattatatatgatggagttgaagtagaaataacttctacttctaccaaaataaattctagttatattttgtttaatttactttcacataaatactctcatatgcatatgtttgtttttatttatttgtttaaaaacataattaaaattcttgctatatttatagattctagttgttatattttttttttattgaatgcattttatctaatttatccttgtactcataaccataatagtgtgataaatcattttaaaaaaaggaaatattatatttcagtttaattattggcacatttgggtttaattataattatatatatatatatatatatatatatatatatatatgaaaataactaattgtaatagaaaatcagtgtatatagacattcaaattcattttgatgatcactacaccatcaaaatcaatttaattcaaacctataaatcaattctaaccataattatgtaaaatcattttggtgcaaatcgacattgattagtttttcatctccttcaatcatcttcttgccttaacttgaaccatctacctatagtgctcttaatttcttacaaacctccaatttctccgcgctaccatgaagttgttggagagcaacaacaaacaagtgtcaattacaaacattggcaaaccgcaaacctatacaaaagcagaaaaagaactgaacaaaaacaattttcttgaatgaatcaacagcttaatattacaagatctgaaattaaatatccatccaagagcttattttgaaactattatacattatgatgcccgagtaaatccacaaaattaagcttttcacaaccattaaatgattcacaaatcatggctacatctttgaaaattggattacctgttttttcaatggtatgtgcctgtttgctcttctattttctccgtatagactacgaatgttacagtagaacatgagtagcaatatagagaaaaataaatgcaaactaactaaatgataggataaaacaaaacaggagagatcaaatttaaggttgttgggtatcatggaccctcaaatcaaattgcggaagcggaaatcaaaaaagaaacgagagagacaatcaaaatttgttttacgtgagaaaaccttcctcaatgtgagaaaagaaaaactcacgggacttagtccggtaccaaaatccactataacaaatcactgttacaatgaatcaaaaacacaccaatagtggtggtacactcaaaatctccaacaatggtggtcactcaaacgctcacagtgtttcactctaagctctcaaatatgcaggcacggaggcttgctcaaatgacactcaagactgtcacttgaggctctcaaatctaggtctcactaatttcacccttaactaatgtatttaaagaggtgaattaggtttagggttttagaaaccctcaatggacatgagtcagcattgaaggggtaaaggtccaataccaacaaaggtattgtgtttgtttaaggaagatattcgcacacgaggttgtaaccagtattagaaaaaccatcttcaaattggacaattcaactactgaactgctcaaataacatgtctgaatgtctcatcagtaggctactggatcgatttgcaattggttagtagactatcatttagtttctctctgatcacaaacacttttttagcttagcaaaacttgaaactaattcttttaaactaattttggtttagtttggttcacaggaacaatttggtgcaatctctctgttttcgattcaaagcccaagtctagaatcaaagcccaaagcccaagtatatgcacttgtgtgaattttccatgcctttctttaatttgctgacataaggggattagagcttatcattagcaaaaaagggtttatcgtccgagtaattgacgtttagctaaataagagaaacttgtgtgaattttccatgcctttctttaatttgctgacataaggggattagagcttatcattagcaaaaaagggtttatcgtccgagtaattgacgtttagctaaataagagaaattgaatcacataattaaggcgaccaagagattatcttagggtggaatcaagggaatttcaacacctaactatttttattaattaatttttctagtacattcaattgtgctaatgtttctttcaatcaaattaaaaaaagtctaaaaattcctaattgtttatctcttaaatcaaaagagtaatcgataatttgattgattgtatatttgataaaccaaatttttcattgatacaataatttgtcctcattttatcaattgtacaactagtacacttttcgtattctaaccaaactccaacaatatactggtaaaaggtgactcagttgatctttaagtcactttacgtgaagtccacattgcccacattaggattagtgttagaaaacattacagttcagagtaaagctttcaatttaatttccatataactaaacgtgatgggaataaagtaagtagaaccgtagaaatatagatgacacaatttgtttgatgttaatgtaaatgtactttcttttgatattcaataaatatgcatgttgtcatcgttaaaaaataaaaagataagctattttttagtttctaaattttttaaatttatctttttagtctttaaattttttatttatatttttcatctcttattaaattggatgatgcattcctgtgtttatcactttattcgatctaaattcctctatggatattaatgaaaaaagaggtccttgactgcttgggcaagtcctcgcgagggaactttatttgttgaagtatgtatttcatttttgtttgcttggaactataataacagatccgtagagatagtctcacaattgatttttaaggcagcatggcacttcgatcaccaaaggttcattccattgatagagtcatcacaccctcaaatacactctttttatcccactctctttcattgctccatctcatcttattttttaacttcgtcctcattgatcctcactcaacctctttgccaatgaataaaataaaggggcaagttacttgaaaggcatagggatagactgtttttggttcttaaacatataaataataaaataaaataaaaacttattaagtgtcataacctgaattttagttttagacattttagtaatgattgtgtaatcttattgaattgattattggcaggctaggatttaagaaaattatgcaagctgacgaggatgtagggaagattgcagtggctgtgcctcttctagtttgtaagtagtctttctctttcatgcatattctagggtgttttcttcttctcttgaaaaatgtttttttttttttttgtttttttttgtgcttttggaagtttctatgaattatctctgattaataattatttgtgtttatgtattgcagctaaagcactagagctatttctgcaagatttgtgtgatcgaacatatgagataactttgaggagggaggcaaagactatgaatgcttttcatttgtaagtgaagtttctattattttctttgttcaaatttttgtctatgtcaagtctgttcaaggtggtcacaaggctgcagatttctttcttttggagggcggttattactatgtacttataagaacatcagatctgcaattctaatgatgatatgatcagtctcaaacaatttccctcttgtgccttctatttatcacatgcacaaacatttttttttttttttttttttttttttnnnnnnnnnnnnnnnnnnnnnnnnnnnnnnnnnnnntagtacaagtagtactattacaaaagagtatagaaatcagaacagacccgtggcaccataatacataactaacatgaattacaggcccaaaattctgaaatgatgtatataccaaaaaacagatctatccagtgatcccacccctactaacaaaagcctcccttaagttactgttccagaagtgataggatttatcaaaagttttatctaagctcttcatccaagaccaacaggtgaacaatgcgtcatccatcaatttgccttgatccagtctgtcgttgtgaaaaataatgttgtttctgtgtcgccaaatcgtccaagccagggctatccaccaaacaagccatctgtgtgaggttatccctactctgaaaaggaaagtattttgggtaaaatgttgcatcggggattcagagaaaggtcctaaaaaatgtatccattgcatagattccagccacaagatcctgattttgtagcaactgaaaaataagtgtgaagcctcttcgttcgtggttccacaaaaagggcacaaatagtcatcaagattcacgtttctccttcttaacttcattttagtgggtaatctgtcctcaatgagtctccaggcgaagcataatgctttgtgaggagctattatcttccaaaggttcttatatgtatcgctttgatgctgtagtacttcatcagagcgtaaaaaagagtaagcagtgcttacagtgtatgaaccgctcgggtcgcccacccacttccaagtatcagattgcagtggactgatatttggattgttgatgtcttcaataaatctgatagctgcctcgatctccccttccctaaaaaaccttctccattgtagctgccactcccatccctcctcggataaaacacccatgtgctgaaaggtatgatgctgttgtaaggatatgaggaataatcgggggtatttatcctttaaagatatgccttcattcctccagtcatcacatgcacaaacatgattagacatgtaaatgacatctgcagaagcaaatgttgggatggtcttgcttttggaacatgtgctgtttgttctagtatttaccttcactttccagtttctaaaatgtccgagttacttgcgtccttgcctttgcagaaaacagtgtgtgcagacttttaatatctttgattttctgaaagatattgtcagcaaagttcctgatttaggctgttctgttgcaactggtgatgaccatgctgtcactaagaggaggtttgtgctctggttaatactcttgttacttggaacaagttttcagtatgctgaactttgtttactttatattaggaaagttgccggagatgatgaaaatgacagcgacgagaagctcaagagaaaaaagaaggtaatttatcaactgtattcaattacttcaacagtggttacggtaaatttttcctgtgtgattaaaccttttgctgagtaattatctcttctccatgcacactgaaccttttgctggatacaaaaaaatttactttagtcaatagggaaactcagtagtggcttgtgaatgcacgtttgtctaaatgtctaatagtctgtgaggctaggccacactgttggagtttttgtttaaactccatgggttatgaataagaggcggttaacaattcaaaataataactactcctaaccgctcttgggaaaggttagaaaaaataactactcccaaccgctccgttaaccaaccgttccgatggttcatcgccaagagtcgcgatggtttaccgacaactcttcaacaggattgtttgttgtctataaatagacacaaagacagtcagaaaagaaagagaagtaaaaactgatagagttttgatagttaatcttttctaatattctcgcttagatactagtgcattttcatatcacataactccatggttcctcaagcattagctttgttcgtttgggctgttgatttgaaatgcatcaatcttcagacgttgatccgttctatcctgggagacaattgttcatcaacctttggcataattggagggaacaaattgtcttaaggagacaacattgttgggctcggatcctttcatctctttgcatctgtttctgattcatacttatcatacaggttctgtttaaattgtttttgtacagttgtagtagattatattgttcctcttgactactcagattttgacccttgtgcaattggatatatattcaaattctaaattaactaatagatctaacagacacttcaacttaaagcttactacacaaagtgccaaaactgtctggttttctgaatactttggctgaaaactatagaattggcactaaagaattggcagttgtttagtattaaatattatctgacttatggaactttatattttttcatgatttgcacagccagagcctggacataagagtggcagaggaaggggtaggggcagaggtaggggttgtggccgtggaattagaactgtagatcaaaagatgagttcacatgccaagtgtgaagatgattctgatgtattgaagcagaatgacaaccacattcaaagcaatgaaaccatggaaaatgtgccggaacctaaagaagttaagcagagttttccagtaagcaaaccggctgaagtgtccattcgaaattttgacttaaatttgaacccagatgaggatatggattcattagacacaccaacttctgtcccaactagttcatctgcaaattcagtgtcagaagagaagcatgaggaataccctggatggtccttgtctgaaatggaaaaaatgaccattgatcccattcaactagccaacataaatggaaggattgatgaagatgaagaggattatgatgaagaaatgtagatgaacctgtgttggtttattcattacttctcatataggcccgtcattagaatgtttttatggggaattagagtagatattgtaggagcagtgttagataaatacttactccttggtagtttaggaagattaggagggatagggcattgaattgaatactctccttataacccttgttttaggttaaaagtggagatatagattgttccaattagaaatagccatttgccagtataattatgacttatgagaaattttaatctcatgtaggtattgcttatggtgtaggcactacattaagattttgggtgtgttatggctcaaaattttacggggatgcctatcttaatcacactggtatctagcggaactaactcactgctccagcaacatgatttgcatgcaaccttttgaatttttggtatcttgaacttattgaacgatgagacaagaggaaaagaataagacgttagacggatagaaataaatacgaaataaagtaaaaaagatttgttatttagatgaataaaaatagaaaggaaataagtgtagaaattcattatttatgtttgttttggacaatgaaagagaaaatacaaacagatgaattgtttgaaaaaattatacattttttaaaaattatttccattatttttctaataagattattattttttattatataatatacttatttgatttttaatatataagcaccactaatcgcttctttgtaaaaccaatcttgcctcaaactaagtttgtttaaaattaaaataagtaattttaaaataaatatttttgaataagcacttaaacaaataacgttgatcaaaataaacaaaaaagctgttttttaaacataatcacaatttaaacaaatacattaaaaaaaaaagaaaattgtttattttattaaaataaatatttttcaacaaataaatttaaacaaatttaacaaaagaacatcacttgagttacgagcgtgagttgggctaattagacacatatcagacaattataaagaatgatttgaataattaactatccaatgtgggacttgtgcctaccatgaggtgaacgttatctaaggtggaacgtaaagaatgttttatggttttgaatctacttggaatactaataagaaagacgtgaaatttggaatactaataagaaagacgtgaaactaaaattccaaagtacagttaacatgatactagctctagatacacatgcttacatgcctccgtccctgattggagacgtatgaagtttatatttaatatggataagtcctaggaaacacagaatagctgggactcaatctcaaagtttggaataattataatttcttattaaaatgtcgatctcaatggttcttaacataataagagtggttgtgacatatacttgaagtttgagtttgcccgtgtctataactatgtaatagacactggcaagtgttcggatggaagataaaatctaaaccacaagtgtttgtcaaaaaagttaaatggaaagagaagaaacataagtattggaaaaacctccattgaagccactgcataaaaaacccacttggaagtgtgatcaaatatcagcaacggagataaaaagtaacacaggctgcagtaaactcgctttctgcaagcaaatcttgatgaactgaaatttgacaagaatgagagtatagacgcagaaaaagtgaataatgcgactgcatttgtcaatacgctcattggttgggatcaattaatgtcaatgcataacttgattaatcttttaattaccacttaataactattacaagttaattttttaagttaagatattaaaaataaaaagaattgacctagcttgaaccatgcgagctctctttccatttgaatggtagctctaaaactggacaatgctttgaattcaagtgacagatgagcagctaagtgtagaacgttgttaccttcattgtccactgctcctactatatgctctatctttttaagtatactaaaaaaatgcttatttttcaatatagggcagccaagtgcagtaggtttcgtccattgttggggtcccttatcatggtcactagtttactattatcgtcaagaatccaaccaagagcctcatcatttcgatatatagttgattggtccaacaaatgtataacatgagcataaagaaacaagttaaattaaagtttggtcttatatgaaacatcaattttttgacacacataattaaataaataaataaaacaccattcgcaaccgatcatgaaagcttacttagaatttctgaaggctttcgccccagcatatgcaatgctgttaacttctctttttgcctcttcatctcttgcaatggacaaatcagttggatatttttcaaataatttcattgccacatctgttacatgcacaaattaaatagcgatggtggattgcatatgtacaaagcaaggtaaaattgaaaaaccacgtacgagttcaactagataaaaaaaaaaaaaaaagatgtttggttttacacttaccaaacatgttactgctatggtcataaaaaaagtcgttgaatctccctataaaccatttagtgaagcagatcctcagaggacaaaatttgcaccattttcttgtggtcatataaaatagccaagcaaactggaagcatcccatctgagtttggtattgttgggtaccaagtaatcatacaataatcaagataggagaaagagaaaaaaatgaaagagaaaataacatatagagtttactttgattcatcaaatatggactacatacttatatttcctcgtatactcgaataaaaaatatataggcttaaaaatataccaaacaagtatggactattcataaacccaaatctaaactacaaataataaaacacaaaacttattgtgagccataccgaacaagtatcagtctagaatgatttgatatacaattctactaatattgtgctcagtctcattaaatctccctcttttgccttctatttctcacatgcacaaacatgattacggccttatcagcggaaggaggtaattgtttttttttattacctaggactttttaaataattagattaaaaaagttatttataatttttttaaaaaaattatcattaaaaacatataaaaaagtaaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaaattctggtcttgaacacactagggtgacccaagcctggattgcattctaaacaccttcttatagacgtgagttatgcatttcatcatttagaatttaagccttggaactggaacctaagatttacgccaaatagttgcagaaaacgtgcagtccgtcgttataatcgattacagcctcaaagtaatcgattattttgttcaaaggatttctggaaaacaaaatatgaacaatgtaatcgattacggcatcggtttaatcgattaaatcaagcttaaacaaaattccagatttttccagtgactgttttaatcgattacaagggtatggtaatcgattacaagcttaattagaagaagcacctctctggtttaannnnnnnnnntaaaaacatataaaaaagtaaaaaaaaaaaaagaagaaataaaatgaaaaaaatgtaaagaaagaaaaaatcacgaatttaaaatagtataataaattatgaaagtcataataaaaaaacttaaaaaaaggttacaaaaatcgtaaaaaaaattatgacttaaaaaaaaatatattgaaatcgtatattttttttatgatttcagtttaaaaaatatcagtcataacctgtgttacgacttatgatatatctctttgcgataaaaaaaatttaaaatttatcccaaaggtaataacaaaaaaaaaattaccctcctgatgataaaaccgtaaatgacatctacagaagaaaattaaatgttgggatggacttggttttggaacatgtgttgtttgttctagtgtttaccttcattttctagtttctaaaatgtctgagttacttgcgtccttgtctttgcagaaaacagtgagtgcagacttttaatgtctttgattttctaaaagatattgtcagaagggtttctgatttaggtggttctgttgtaactggtgatgatcatactgtcactaagaggtttgtgctctgattaatactcatgttactaggaacatgttttttgtgtggtgaattttgtttatttgttttatattaggaaagatgatgataatgacatcacgaggatcccaagagaaataacaaggtaatatatcaactcagattgagttggcttaaatttttcttttgtgactaaaacttctgctgagtaattatctcttgtcaaagcagactgtggaccttttgctggttacaaaagaatttacttcagtcattcgggaaattcacaagttgcttcactgacttgcgaatacaagtacatttaatactctgtaaaccttactatacaaagaaccaaaactatctggttttcttaaaacttttggtgaaaactgttgttgtaattgagcaaactattcactatcgaatcagaactaacacataatgtggaaattctagctgagagatgcaacattctaaagaacctcgcagcagcttgatgttaaatattatctgaataatgattttttttttcttcatgatttgcacagagcctggcattgcagtggcagaggaagggggtatcataaaacaattttaggattttacaaattatcatccaatcaaaatttatcattttaaaagttaacaaatttttttattactttatttctcttcattttaattttatagttattataattttgttgtatataataattctttttaaatcgagtaggattaagtctcagtgaaagatgaatgtgtaacaaaaaaaaagctttttctgtgttatgatttgctcccttcagcaaccacatggaaggaacgggaaaagctttggcgtgggttatgcagtatagtctcaaattaaggcgggaacaataagaaaggtaatatttcatgagatagaaaatgtagaatagtctcaaatttaaacacaagcttgattgttccacaaacaaataataatacagtgtcttaaattctgccaatttgtctgtaactctgtaataagataatccagttaggacaaactataatatttagcccacaagtgtttctcgagaaagttaacactaaagagaagatagtaaagcattgagaaaagcccaattgaagccactacataagaaacccacttggaagcagtgtgatcaaatatcaaaaaggaggctgcagtgaaagccacaggaatagcagcaacggagaaaataagtaaccaacgcccaaaagtcaagctgggatgtagtgattttacaaaatggctttgggctaatcttgatgaagttaaatatcgaaagaatgtgagtaaagacacagaagaagtgcataataagactgcatttgtcaatatgaagacagtaaaccaaacattggtcttatcacctggaacagtcagagcagccgcaaatgctacggtagcaacaagtgttgacacaagcatgccagattcggctattgctttggctgtttccttaatttcttgggataacttcttgtgttcttcagatattacatcaattggtgtcttgcccatgttgtttctcattgttcttagttcacccgccggaacattcgactccacgaactatttacaaatcaagagaatatgtaaatgatggtatccaaatgcataacttaattaatctttaaattgtcacttattaactagagcacagcaaaacctcttaaatttagtgtaatgacaaatattttcggaagtattagcgtaaagtttaaggggatgttagggtaatgtttttaaagcatataagagatgttagtgtaattttgcaaatttaaaagaaatttgtgtagaaaaataaaaaatggaattacatataattatatgaaatctcaggaaaattattgtaatttcctcaaatagctattacatattaaatttgtaagaaatacaatttcaaagttaagatatttaaaaaacaaatcttaggggtgatatttatttttacaaatgcacttgtattatttttaattaaaattttctattatatattggctgtttaactattatgctaaagacaatggataacaaattttaaaaaattattacaataatcaacaaatactacaaacaatgatttctatttttaattaaaacttgttacttttaaagatttaaaatcagtctagttaacataagcctaaaattagtggaattttaaatttttaaaataagattgctagaacctgatcgatcccatgcgagtgaataaagaatggttgaataaagaaaattaagcaaattaattgacctggaaccatttgagctttctttgcatttgaatgcttgctgacaattcttcttcgaattcatcttctgaaagacgcccagccaagtgtagaatgttgttacctccatagtccactgatcgtcctagaagatcttttaattcctgtggtataatattaaatattatttgttgtcgaaataacacaaccaagtgcagtaggttccatccatttctgcggtccctataaggcactaatctaggattattgccaagaagcatcttcacagcctcaacatctcctgattttattgcatattcacgattctgttccaatgtttcaacttgagtcgatacttctccaaatagccgatcacaaacgtctgatttggcaaacattaatttgtgttatttgaataactcaacaaacatcaaataccattattacactggatatagataattaaggactaattcttaattttttatataaaacaaaaatatatatataactttctaaaatcaaaatcaaaatggaaatgatgtcaaataagatctaaattttagcttaaaacacacaaaaaataaaaagccattttcaacttgtgaaaggttacctgacattcctctaggcttttcccccagcatcttcactgctgtaacgtcctcttcatttcttgcaatggccaaagcagttggatgtttttcaaataatcgccttgccgaatctgttatatgcacaaattaaatagtacaaggcaaagtaaataaaaactccaactaaattgaaaaaccacgtacgagttcatatatatctccttttatatatatgaaatcaatgagaatttagctaggacctgtttggttttaaaggatgatatcagtctttcagaaacctaatagtcataattaattaattcaactgatactcattaaatttgttattgaattatggtcaaatgtaccgaatgaggttggaattgtaaacattatatatatagcttatggtatctgatcggttcaatgggttccattcagtttgtaaaacttcataatatgtaaaagagaactagattacaaaaaggagaaataaggttgtttaattagttttacacttaccaaacatgtcggtcctaatggtcatcataaacagtcgttcaatatatttgaaatccattttctcaagcactttctgagaggacaaaatgtccaccattctgtcgttggaacgatataaagcagccaagtgaactggaagcatcccatctgagtttggtattagcatgtcttctggcctcatacgcttaaccaactcattcacaatatcaaggctgccttgacttgttactgctagatgaagagctgtgtctctaaatgagtttggtattagcatgtcttctggcctcatacggttaaccaactctttcacaatttcaagcctgtcgtaacgtactgctagatgaagagctgtgtctccatatgagttttgtattagcatgtcttctggcctcatacgcttaaccaactctttcacaatttcaaagctgcctcttcttgctgcttcatgaagagctgtctctccaaatgagtcttttattagcatgtcttctggcctcataagcttaaccaactctttcacaatttcaagcctgccttcccttgctgctagatgaagagctgtgtctccactatcatttaacggaatgcataccatatcaggatatttatctatagtcgattttgattcgagccactcgtccctccctatatgtctcgtcagatcttcttttaaagaacctgcaatcctttcaaacttcacattataacatgtcatttatataataatcataactttctgtatttagttgcaaacacgacccttttaatttctcttttcccctaaatctgtaaaaattctcctggaaacttgtttcaaattttgaattcctaataattttatcatttgtaaattgaaatctagctgagaaattccagattatatatgtagtagtcgaagggatccaatcatcaatcacctttaattaagtttgaaatttgaatttcaatttgtgtctgaaaattaattctatgatgataagtaaaatttatttttccttttcttcagtagctaattgatcttaacatgtgactgatatacttatttatactcatactttaaaagtgattctacttttttttatctttcgaataaaaaaataattttctaaacccattgttgaaatatcattcgtataataatagtataaatatatatatatatatatatatatatatatatatttaaatcaagcggtttcaaattcaattttttcaaaatgtacaataatcaaactcttaagacatgttctctgaaatgcaccctcttgtgaatgcaatagtttaaagtataacttactcagctcttctggattcatttgatacactcctctgctttcatgttttggtgtcggtgagtttgttgaagtggcaattggagtttggtcatgactttgattaggagtatgatctggtggaatctgaattatgtggtcatctgaaacttcggtattggagttcatgatttaattctagggaaaatcaagtgatttggatacctctctaaaattccctgtgttgcttctttctttccagcctgagaagcttaacatattatatatggtggtaaaacaagagcccttaattacttatttttccaacttgcacttaaaataactatttccgatgtgacattttgtggattacagctatgttaattgaatctgttcaacatttcaaccccacagttttcaaaagctttttaagttgaatgatttctaaatttataatattaattcttttttaaaatatattcattaaatttgttaacagaaaaaaattgtacacattaaattgtgtggattaattagcgagactcagctatcatgacactgttaattaacttactctcaatttaatattacctgtcttcgttgtacatgataggatagtggtggttatatattttttatatatttatctaacttccgttgacgcatttataccagttatagtcaactactccaacaatcattgaattcaaagcaagactagatgcattttgttatagaaaaatgtatgaattttattaaactcactacaacaaccattgaattcaacgcaaaagaatctaaataatacttttttaataaaaaattatcaatttggagctgttttgaaactatttatcaatatggagcagttagtgacgtccaaattcgaacgtgactaaatccgtcgctaaataggccgctaattcgatctctaacagtttttgacagaatattttatttttttgtttttgcgaagacaaattttgtcgcaaacactgttagcgactgatatagagacaaaaattggcgtgatttaattttgacgtaaaatattatttaatattattaattgttattttaatataattttaaagtatttttagaccgatattcaccatagatatgatcttttttatttttttaatattttttatttagtatatttttttaattttatatgattttatttaatacattcatgattttaggtatatctaatttttaatatattattttatttaatataatttctagatttttatatgattttgtttagtattttttggattttttataaaactaatttttaatataatattttatttaatacaaattttcaattttattttagaatttgaaaaaattgaaaaattttataacttggggctcaagcttaattatccaaaatgcgtatgatatattttaaataaaacaatattaaaaaaagtaaaaaatattatatctatgatgaagatcggtctaaaaatactttaaaattagataaaaataacaattaataatattaaatgatattttacgtcaaaaattaaatcacgccaattttagtctctatttcagtcgctaacagtttttgcaacaaaatttgtcgtcgcaaacataaaaaaatacaatattctgttgaaaaactgttagcgactgaattatcgacggatttagtcacgcccaaatttggatgtgaccaactgccccatattgataaatagtttcataacagttccaaatttataattttttattaaaaaaatattattttgatttttctgccttgaattcaaagcaagactagaaaaaaaatacttatttaacattttaataaaatctattcagttatattaataataatttttatgatgtttgtatctctttatgtcacggatgaaatttaatatattaataaatttttcataattttttattttcaaaaattaaaattaaaattttcatttttaagaaatcaatttattaacactttataaatttcaaaagataaaaataattaataactaacacaatttttataaagtttaggaagacgcaaactataatgggatagtgtaatgggtctcgtagagtcagaaagtattttatgaccatcatattaccttgtttaaaaatcaatgacagtaaattattcttctttgattattatttttcctttttttgtcctcctctttcccgtactacccttttcctctttcttctcttctttcccattcttcctctttcgtctaagcggcaacggtggtgccatgacggttggtgatagtggggatgttgatgcatcgttgcctgaattttatactaaattgtgcaagatgtaactatctatataaggtttaggatttaggatttaaatcatggataataagaaccctaaatcctaacttataaaccacatggaaagaaaaagactttgacatggtgtatgtctagtttattgaaaagataacatggattaattatagtatgtttgaattttggctttaaaattatcatgaaatatggtgagataagtcaaatttaattttatctaaaacttattaaatggatcatgactccacctgtagtaattttacaatttttaatttttaataatattataatttttatgtatttaattattatattttaattaataaaatatattattattaatatgttagtatttaagttaacattttttattatcattataataaatatttatgacaatataataaaaccatgataataaaaaattaccataattattacaaaaacatattagtgttaattaaattataatccatattatctcatgcatcaattatttgtagactataaaaatattcctaattaaataagagagaaactattttagcatatatatttagaagagagaaacattaatgataataatatttttgaattagataattgaatcttataaataggaataaatagtataatatattagatagtagattttgcatgtttagttattttagtataatcaattttaattaaaaaaatatggtagaattaaagtaggaatagcttctacttctatcaaaataaattctagttagattttgtctaatttaatttactttcacatcaatacgctcatatgcatatctttgttttttattgatttaaaaacataattaaaattcttgctatatttgtagattctagttgttatattttttttattgaacgcattttatctgattaatcattgtactcataaccataatagtgtgataaatcatttagaaaaaggaaatattatatgtcggtttaactattggcacatttgggtttaattatatatatatatatatatatatatatattgttgggaaatagaggggaataaatatcggggagatttacacgagcaaccatataagtgagctagacaccacactttcaataatctccctctcaagtgtgagtctctttcacatggtaaacaaactccccctcgagcggaaaccaagactcgctggcctacacatgcatggactcactcgccaggaagactttcgatacaaaggatcttatgtccatggatccataaacgcagcccaaacaaacgagccgcgaaccatcggctctgatattagagttgggaaatcgagaggaataaatatcggggaaatttacacgagcaaccatataagtgagctagacaccacactttgacccaaaaccttaagactcaggtttatgggtcttctcctcacttatatggtgctaaatttttctatttctatccgatgtgagactttaactcacacttgtactcgaatatatatatatatatatatatatatatatattatataattaaacccaaatgtgtcaatagttaaattagtgtatatagacattcaaatccgttttgatcatattacaccatcaaaatcaatttaattcaaacaacaccctcttaatgaattataatgaccctcacaattaaagtaatgagctatggtttaaatgaagaatgtaaagattatgataagtagtaaaaagtctaattatgccaagcaagtcaagtaaaactcttattataaaatatatatatgataaaagtatattgggtcgatttgaccatttcatgaagttaagagtgaatgcaatagttttgagttagaaggatataagttgaaatgatataaagtataagaagtgatgattaaggtttgtgattctagacttatggtctagataattggaaggaaacaatattttggccttaagtgtaaagcaacaaaagactaaaattacaagagttcactagaataattattccaaactcaccacctaatcttgtgacaactatattgaaattctagtaaggtctattaaattgtgatgacataaggttaattccaatcagccatgatcttaaattcagccaaggtagcccaatggtagtgaccattcactcaattggaaattagaaataaccttggattaacccatttaataatctggctatttatccacattagaggtctgaatttggcctcagggtacgctacctcaagtctcttttatgcctacatgagctgagcatttagacaaggggagatcagcattgtggacccctccatttctttagaacctgaccacttagtggcttatgtccagccttgtccccctcttagtgcactcaattcggaaagcatgtggtctgcctcacaagtaactaaacattccactaaattttaggcactcaatttcagaaggaatcctgcaaagcaaaaactgcccagccattatgttggacagcatctttttccaagttccaatgactgtccaaagctggaggcactcctactccattatgctgtgcacctagcattatcaactccgtgtactaagcattatttcacctcctaacctctttgccgtacacctctctgctccaaagacataaggtttcaacactccccctttccaaaaaccagttctggaaatttcagctccttcactgtggtttctgcagtttgaaagcaacaaccaagtaagtcctaagactcctctctatggcagcatatcgtagggaaaaggtcatgtcttcctaagatcattttgatagattttctgtttatgggtggcagtacattcgaactcttataaaactgcattcatggctgaaaagttccaccttgttgctaaaattctggtcttgaacacactagggtgacccaagcctggattgcattctaaacaccttcttatagacgtgagttatgcatttcatcatttagaatttaagccttggaactggaacctaagatttacgccaaatagttgcagaaaacgtgcagtccgtcgttataatcgattacagcctcaaagtaatcgattattttgttcaaaggatttctggaaaacaaaatatgaacaatgtaatcgattacggcatcggtttaatcgattaaatcaagcttaaacaaaattccagatttttccagtgactgttttaatcgattacaagggtatggtaatcgattacaagcttaattagaagaagcacctctctggtttaatcgattacggatctatgtaatcgattatttcgttcacgagatttctggaaaacaaagtatgaacgaagtaatcgattacttgatcggtttaatcgattacatcaagctttaataaacttcagatttttctaataactgtggtaatcgattacaaggaaatggtaatcgattacaggcttaaatgaaagaaacgccttctctgttttaatcgattacaaggggatggaatcgattattttgcctagaaaacaaattgtaatcgattacgtctcgttataatcgattacacaagctgttatttgagatccaacgttntttggaatcctttgcctgtgtgctcaataattaacagccattaagtttatagcttgaagtcctagagttctgagcaccacctgagtatatttatgggtgttatggcttccattattcattcaaaaatcatgaaggtgttagtgaagcaacctagttcatcacaagtcataggaaagctgaatttcatttattgatggtattcaacctaaggtttcagtcagattcataccaatcttgggttagaacagagatattgttaaaaattatattaaaagttacaccactttaaaggtataagaagataggagttttgacttgcatattggcataataataataataataataataataataataataataataagagcatgtggttaagaaaagaaggaatcaataaatgaagaagtcttgtaggatacttgacttattatgcaataagtaataatgtgactgattcctactctaggaccacatagagaagtggaccattgaggagctcgactaggagcatacgttggagttccaggtaagcttctggagcttacattagcctctttttctttgaagtccaccgtgagttacatcatggtgtattgatttatggtagttgaatgatatgatgataagatgttatggaaggtaagtctcatagttgaatgatatatatttaagtgtatgcattctcattcataattgctgtatgagattatatgttgtatgcactgatatgaggataagactttgggttcgagtcccaaagcaccatttttataagactttgggttcaagtcccaaagcacctattgtcatgacaattgtaagtccttggcagaggaaccgaggcaatatgagatgggtgtagagtaagacttcgggttcaagtcccggagcatcaaagcaccaaagagataagtttaattgattgcattattatgatgtttcttttatctgtatatttatatatctgttaatgttatctatatttgttactgttttatatacttttattatagactgttgctcaaaaggtgagttcagggacttagaggtttctttaagcccctggagcttactgagactcgggttgtctcaccccttttcttggggaatatcatttcaggaggagttagtaagggagatccctcttctagcaaggctcctatgggcgcctgatggagcagcagctactgttgacttggattagattatcttatcgtttgcgtgtgacatatttgggcgtgtgtttcagtacgataggactaccgtagtacggttgatccgttgatggataatctttatgttgagactaagtttgtatttgtgccaccgccttaagggtggatatctgtatgtacgacttaagagttaattatgtatgaagtattcagctttctatattaagttatgcctggggttattagttaaattaaatctagcatttgcagtatcgtattatgtgaacttctgggaaaagaatttgagaaaatgtttttggaaaatttaatcacgattttttatactatgtttccaaaacgaattttaataagtcttccgctggaaactctagtaccaagatgagtaacaaccggcagtactacggggtgttacacttaatggtatcagagcagttcgtggaatgttcactgatatgatgctgtagtctagaattagatagagtcgagtagtgaggaataggagaaaattctaagataggcgcataaaaatctgtttgtttgtatctcttgtggaccatgttattgtatgtgccatcacttgattgagcgtagctaactcataccttgtgtagttgtgcagtatcatggccccacgagggagacccaggcgagtagcaaacaatgcgccgaccgatcctattgcggctgcactagctgcctttcagcagactctccaagagtctagagagcaggatctagagaggatgaggaaggctaatgaggatatgatggcccagaatcgtatggcgacagttgagatgttccgactgttgcgagctgaattgagagctccccctccgtcaggtattccgatggaggagaacgaaccggaaggcacagctggtgcccatgctgagagagaggaagcagctcatcagaatggcggtcctcgcgtcgagcatgttggcgagcctgtagaaccactgttagtgaacagagaggcacgagaaaggttatacaatgcgttcaggaagcatgttccacctccctttaagggtggaagggaccctattgctgcattggagtggctccaagaaatggagcgtatatttgaagtcatggaaaccgatgatgccactaagttactgtatgtagtttatatgctacaaggagatgccgcagactggtggaagaacaccaaacttctgttggagggtcagggacacgttgtcacttggccaacatttgaaggacaattcataaccagatattttcctgatgaggccagagagaggaagaggcatgagtatgaagatctcagacagggaagcatgtcggtggatgaatatctgagtaaatttaacaagcttgccaagtattcgagttatggtaggactcccctcacctctgaagacaaggcgttcaggttcaggaaaggcttgaatgatttctatgctgatagactggccgggcaaagtactaaagactttgctgaactggtcagaaattgtctgaatatccaggagcattacaggtctagaggcagagagatgggaaataaaaatgctagtggcaagacttttcagtggcaaggaaagagtaagacgctccaaccaaggaggaacgacaaccaattcaaagggaataataagggaaacttcagaaatggtagtgtggtgacaggcaaagacaaggtttctccttgtgctaaatgtgggaggacacaccttggtatttgtagaatgggacaaattgggtgctacagttgtggacagccaggccattactcgcgccagtgcccgcagaaagtagggcaagcagcaatgttacaggcagcaccgattccggccgtcccacttcgagcagttcctacttatgatattgctaaaccagtggtacctacttctacaccagcagagcagtatcctgttcagacgagtgcacgagtttatgtagtcacgcagaaggatgctgaaaggtctcctaatcttgtaaaaggtaccatttatattaaaggccatgatatagatgcattgtttgactcaggagctacccactcctttatatcgaattttgttgctattagtttaaatctgatcatagacaaattcagtcctcctatggtagtgaagactgccaccggagtaacagtctcgactgattcgttttgcaaagaagtaaagtttatttatgaaggcagggagtatgagatcgatctggtaatgctagaaggcatgagtttgcaaattattcttggcatggattggttagtcaagaatggagttatgatcgattgttgtagccaaagaatatattttgctgatcagaaggagaaagaggaaagtccatgtttgtccctggcaaaaatgaaaaaggccttgaaagaagtaggagaaggatatttgttattagatgcgttgataggagcatcaaaggagcccagtgctaatattccagtggtgtgtgagttcgaggatgtatttcctgaggagattccacagtttccacaggaaagggagattgagttcaccattgacctgttgcctggggttggaccaatttcattagccccgtatcgaatgtcaccggtagaactgatagaactgaagaagcagatagaagagttggcacaaaagaattttatcagaccgagtgtgtctccttggagagcaccggttatttttgtcaagaagagggatgggactagcaggttgtgcactgactaccgacagttgaataaggtcacagtgaaaaataagtatccattgcctcgcattgatgatttgttggatcaacttaagggggccacggtgttttccaagattgatcttcgttctggataccatcaaatccgggtaaaatccgaagatattcctaaaacagcctttagatcccgatatggacactatgagtatttagtgattccatttggacttaccaatgccccagccgtgttcatgagttatatgaatcggatctttaaaccctacttggatcagtttgtagtagtgttcattgacgacatcctgatctactccaagaataaggaagagcatacgcagcatttgaggacggtgttgcagacgttgagagaatacaagttgtatgctaagccttctaagtgtgaattctggttacctgagattcagttcttgggtcatgttatctcatcccggggagtaagtgtagatccgagcaaaatagaagcagttaccgaatgggagagaccaaagaacgtcactgagattagaagtttcttgggtttggctggttattaccggcgcttcattgaagggttctctaagagggtgttgccattgacgagactgacccgtaagggtacaccatttgtgtggacacctgagtgtgaagcgagtttccaagagttgaaacggatgttgacttccgcaccagtgttaattcttcctgatcccgagggaaaatttgagatttattgtgatgcttcaaaattgggtttagggtgtgtgttgatgcaagaaaagaggccagtagcttatgcttctagacaattgaagccacatgaggaaaattaccctacccatagctggcagcagtagtgttcgccttaaaaatatggcgtcattatctatacggggccagtttcatagtgtatagtgatcataagagtttaaagtacctctttgatcagaaggagttaaatataaggcaaagaagatggatggagttcttgaaagattacgactttgatctacagtaccacccagggaaagccaatgttgtagctgatgcattgagtagaaagactatcagtgttgccagtttgatgatctccgaatatgagctaattgagaaatttcgagatttaaatattcctgtgactccacccgaggcgttatacgtgacggccacagttgatgtgataaattcactggtggagaggatcagagaagcacaaataaatgaccaaatgatacagcaaatgaaggagcaagatttcatatccactgataattcaggggtcaaattctataagaataggctgattgtacccaagggtgatatggttgaggcagtgttgtctgaggctcacatgggcaagtatactattcacccaggagccactaagatgtatagagatttaaagcaaaatttttggtggcctggaatgaagagagatgtagctgagtatgtgaataaatgcctgatctgttagaaagtgaaaatagagcatcaaaaaccttcgggtttattgcagccagttgagatacccgagtggaaatggagtagcatctccatggattttgtagtggccttgacgagaactcagggtggatatgactctatatgggtcattgtggatagattgactaagtctgctcattttcttccagttaagacaacgttcaccagtgagcagctagcccgtttgtatgttagagaaattgtaaagctgcacggggtcccagatagtatcattagtgatcgggatccaaagttcacgtccagattttgggaagccttgcatgaggcttttggtactcagttaaggttgagtactgcctatcacccgcagacggatggtcagactgagagaacaattcagacgctagaagatatgttgagagcatgtgttttagagcagggaaatgcatgggataagtacatgccattggttgagttctcttataataacagttatcatgctagcttgggcatggctccgtatgaggcattatatggtcgtaggtgtagaacacctacttgttggacggaggttggtgagagacagctttttggaccggatttggtggaggagaccaccaaacagattgaaatgattagagatcggttaaagaaagctcagagccgtcagaaaagttattatgacaagaagcatagaccagtagaattccttgaaggtgatcacgtttttatcaggttgtcacctactactggtgtaggtcgtgctttaggggtgcgaaaactgagcccccggttcatcggtccatatcagattatgagaagaattggaccagtagcctattagttagctttaccgcctaatttggcaaagattcacgatgtatttcacgtaagtcagcttagaagatatattgcagatagctcccacatagtacagcccgatgagattgaggtcaagaaggacctcaagtttattgtagggccttctaaggttctggctagagacgagaagaagttaagtcgtgtgatcccaatggttaaaatccaatgggaaggtttaacatctgatgatgccacgtgggagcgagaggatgatatcctccgattgtatcccgattttgatatcaggtatgtctagattttgaggacaaaatcttttaaaaggtggggtgaatataatgaccctcacaattaaagtaatgagctatggtttaaatgaagaatgtaaagattatgataagtagtaaaaagtctaattatgccaagcaagtcaagtaaaactcttattataaaatatatatatgataaaagtatattgggtcgatttgaccatttcatgaagttaagagtgaatgcaatagttttgagttagaaggatataagttgaaatgatataaagtataagaagtgatgattaaggtttgtgattctagacttatggtctagataattggaaggaaacaatattttggcnnnnnnnnnnnnnnnnnnnnnnnnnnnnnnnnnnnnnnnnnnnntgtccagccttgtccccctcttagtgcactcaattcggaaagcatgtggtctgcctcacaagtaactaaacattccactaaattttaggcactcaatttcagaaggaatcctgcaaagcaaaaactgcccagccattatgttggacagcatctttttccaagttccaatgactgtccaaagctggaggcactcctactccattatgctgtgcacctagcattatcaactccgtgtactaagcattatttcacctcctaacctctttgccgtacacctctctgctccaaagacataaggtttcaacactccccctttccaaaaaccagttctggaaatttcagctccttcactgtggtttctgcagtttgaaagcaacaaccaagtaagtcctaagactcctctctatggcagcatatcgtagggaaaaggtcatgtcttcctaagatcattttgatagattttctgtttatgggtggcagtacattcgaactcttataaaactgcattcatggctgaaaagttccaccttgttgctaaaattctggtcttgaacacactagggtgacccaagcctggattgcattctaaacaccttcttatagacgtgagttatgcatttcatcatttagaatttaagccttggaactggaacctaagatttacgccaaatagttgcagaaaacgtgcagtccgtcgttataatcgattacagcctcaaagtaatcgattattttgttcaaaggatttctggaaaacaaaatatgaacaatgtaatcgattacggcatcggtttaatcgattaaatcaagcttaaacaaaattccagatttttccagtgactgttttaatcgattacaagggtatggtaatcgattacaagcttaattagaagaagcacctctctggtttaaatcgattacggatctatgtaatcgattatttcgttcacgagatttctggaaaacaaagtatgaacgaagtaatcgattacttgatcggtttaatcgattacatcaagctttaataaacttcagatttttctaataactgtggtaatcgattacaaggaaatggtaatcgattacaggcttaaatgaaagaaacgccttctctgttttaatcgattacaaggggatggaatcgattattttgcctagaaaacaaattgtaatcgattacgtctcgttataatcgattacacaagctgttatttgagatccaacgttgaactaatcgattacactatcagttggagctaaattaatcgattacatcaggttctaattgcctatttttggaatcctttgcctgtgtgctcaataattaacagccattaagtttatagcttgaagtcctagagttctgagcaccacctgagtatatttatgggtgttatggcttccattattcattcaaaaatcatgaaggtgttagtgaagcaacctagttcatcacaagtcataggaaagctgaatttcatttattgatggtattcaacctaaggtttcagtcagattcataccaatcttgggttagaacagagatattgttaaaaattatattaaaagttacaccactttaaaggtataagaagataggagttttgacttgcatattggcataataataataataataataataataataataataagagcatgtggttaagaaaagaaggaatcaataaatgaagaagtcttgtaggatacttgacttattatgcaataagtaataatgtgactgattcctactctaggaccacatagagaagtggaccattgaggagctcgactaggagcatacgttggagttccaggtaagcttctggagcttacattagcctctttttctttgaagtccaccgtgagttacatcatggtgtattgatttatggtagttgaatgatatgatgataagatgttatggaaggtaagtctcatagttgaatgatatatatttaagtgtatgcattctcattcataattgctgtatgagattatatgttgtatgcactgatatgaggataagactttgggttcgagtcccaaagcaccatttttataagactttgggttcaagtcccaaagcacctattgtcatgacaattgtaagtccttggcagaggaaccgaggcaatatgagatgggtgtagagtaagacttcgggttcaagtcccggagcatcaaagcaccaaagagataagtttaattgattgcattattatgatgtttcttttatctgtatatttatatatctgttaatgttatctatatttgttactgttttatatacttttattatagactgttgctcaaaaggtgagttcagggacttagaggtttctttaagcccctggagcttactgagactcgggttgtctcaccccttttcttggggaatatcatttcaggaggagttagtaagggagatccctcttctagcaaggctcctatgggcgcgtgatggagcaacagctactgttgacttggattagattatcttatcgtttgcgtgtgacgtatttgggcgtgtgtttcagtacgataggactaccgtagtacggttgatccgttgatggataatctttatgttgagactaagtttgtatttgtgccaccgccttaagggtggatatctgtatgtacgacttaagagttaattatgtatgaagtattcagctttctgtattaagttatgcctggggttattagttaaattaaatctagcatttgcagtatcgtattatgtgaacttctgggaaaagaatttgagaaaatgtttttggaaaatttaatcacgattttttatactatgtttccaaaacgaattttaataagtcttccgctggaaactctagtaccaagatgagtaacaaccggcagtactacggggtgttacatgaatcacttttctgatgttgatggagtatgatacttccaagtgttaataataaccggtaaacaaataactattttaaaaaataaaacgaggtgaactaatgaaaagattggtgaaaagagtgtgtttgagagtgtgattctaatattctttcttattttattgtagatgcactttcttttttgagagtgtgtttgagaaatgcatttaaaactagataaaactaagaaataattttgttattaagtatttttaatgttgtctctaatcaaaaattgtattttaagatcccacttaataaaagtttgtgttaaaaattagcataagttagtaagataaattttctatttcagttaaaaaaacactacacataatatatatctactatacatatatgaaagcaataggcatatgaaattcctttcatgcccttttcagttgattgacacttggcaaaaataggggtaaaatggtaattgaacattaaaatgctaattgtacctccttattaataagtgcacttccatattcccaaattaaaaattgctaattgcacacctttttttataagtgtactccaatattttcaagttaagacttgctaattgcacccctttttgataaataattaatattttattttaaatcttaaatactcattagatcattttttcatctctttcacacgttatctttttaacgctaaccagcggtatttcctatgtatgcaaggtatcgtactagccagttaaaaaaatacaaaattctaatattattttaattttttcctttgaaaagactctaaataagtgatgatatagtaatttctctcttatttatttaacaattgtttagaaaagtacagtgatttccttttattttatattatgattttcacacgttatctctttaacgcgtaaccagtggtatttcctatgtacgcaaggtatcgtactagccagttaaaaaatacaaaatcctaatattatttaattttttctttcgaaaaaactctaaataattggtgatatagtaattcttctcttatttacttaacaattgtttagaaaagtgaagtgattttctttcattttatgttatgattttcacaatctcctactttgggtcattcatatttctcaatattgttggttcccatctcaattgacttagtctaattattgacaagtttgcacacgcgtaacaagagatggagtcttaagttgatttattgtttaaggctttatttcaactgatgtgtattatcacgataagaagaaattattattgaacttcacttctttctttctcttattaatttacttgacaattgtctagaatacagtgatctcctttcattttatgttatgatttccacaattttctcctttgaacccttcatatttctcaatattgttggttctctccttaattggctgagtctaattattggcaggtttgcacaggcgtaacaagagatgaagtcttaagttgatcaattgcttatggccttatttcaattgatgtgtattatcacaagaagaaaaaattattattggacttcacttctttgtttctcttatttttgtttcacattcattttgtcattaataaactatgttaaatcttgaagtttttaaaatatctttccagtctagatgatatgttgtcttaactaccttttaaagagttatgtgtgttcatatattttctttatcgtcttctttttgttttcttaaatctgaaatgttcttcttctctgatgttctctgtcttctcaccatttttctctcttatcttaccttttttattcactcaatttattttctctcttctaaaaataaaccagtgaaatatatttttatttctccattaaccattcaacatcacaaccctcgctgaagatgcctttgtcagccactgtggctacaacttcttcattatttgttcatgatttatagtgacctgtagcaaaaaaggtgaacaattttcttactttctattttcttggttgattttgttttggcctaattgttttctttgtttttccctccttcatcaaaatttctctaatattgtgaatatgaactaaatttgttaaaaagtttatttgatattgtctatcggttaaggtattttataggaaaaaatactaaatgtgtctttataagaatagacgaaaattggagaatttttaaaatatttatttgattttgttctaggctgatttattggttacaaattatgggttttatcaaatgtcaaaatgacattttgcggtatgtttctttatttctcattttacttttgaatttatgacaccttttgagacgactttttatatgagaactttttagttgattccgttgatttgtattattttatcatatatggttttctcatatacaatctttggttgttgcttatcttttgttaatattactcctatttatgttcaatagttcaattatatttgtttagaaaaagtaagtaaatgaaaattgatgtttattgtagaaatttaggtgaacgagtaaaggattaatggaatgttcaattattaaattcgatacaggacctttataaaactgagcatttacacaaacaaaagtgaataacatgataaaatagagagaaatgaagatattacttgggtaaattgaaagagaagagctaagcaagtgaaaaatttactagcaaaacattaattttgcataaagttttttattgtttttctttaatttaagtttataactgaaaatattatgtctagcaacaaatgatgtcattttgaagtcctaccttattttttttatcaaagttatggtcatacctttgtttgatcaaagttttattaccaagaaattcagccacctacacaagttatatatatatcaaattcattttcaactaattatgacgtacataacaggtttattgatttcattgtacacatattctcttatgttatgaccatattaaactacttataaaaataattttatattatcattccaatatatattttcttatcaatgactttctttacttttgcaattcatcatcataattcccagtcatttctacatttgcctatacaaataaaaaaaatcatatataatttttatttacattatatgtgtattaaatatacacactaaaaatcataaaatttacagttaattttaaataaaaaatataatgtgtattaaatatacattaaaaattttagtgttatatgtatcaacattaattattttttaacataattgacttattaattcagttggttggaaccttacggattggactaatccattaaaaaatactttagaattgcccaatccgtaaaaaaaaaactcatacaaattacggattcgccaatccgtatgaaggttagagaatatgtaacattcaaacaaaatagatgtcattttgcataaaatttttcaattgttttatttaatttaagtccataactgaatttttttttgtctagcaacaaatgatgtcattttgaagtcctacttttttttttatcaaagttatggtcctacctttttttttatcaaagttatgctaccaacaaattcaaccacctacgtaagttatatatatacaaaatttattttcaactaattatgccgtacataagaggtttattgatttcattgtataaaaattctcttatattatgaccgatacataatttttcttgctttttgtatcacttcatctatatactatccactttattaacaaaaaaaaattatgtatcatgttctctgaatttaggtttcacaaatttattttgttttttatgttacattatccttcttcatgaccaggccgaatagaactgtcatagaaacaaaagtgttaatgaataagaacattcaatgaaaaaactaccttagtatcaaacatgatgacatagagtatatggttataggtgtcatgagagaaattaaaaagagcaatgttcatgcttgcccaaataagcttcccagtcattttcacatttgcctatcacaggttcttctactttggttgctcaactttatgttatgatcatactagactacttatacaaataactttatattatcatttcaatatatattttcttatcgatgactttctttacttttgtatgtccaatcatcacaacacattctttaaatatccactatcatttaattatttacaattccaaaataatagttacttatacaaatatgttgaatttaacatatttatatttataaatttgtaacaatataattaacatataatataagacaccagaataatttttacaaaaatttttattcacattttcaatcattattgcataaatctatattatttaatagactttattattaaactcaaacgacacatactctccacccgtgtctcgccatttttctctcttctcttaccttcttcattcactcaatttattttctctctcttataaaaataaatcaataaaatatttttttatttctccgttaactattcaacatcacaacccttgccgaaaatgcctttgactacaacttcttaataattttttcatgatttatagtgatttattttctctctcttataaaaataaatcaataaaatatttttttatttctccattaactattcaacatcacaacccttgccgaaaatgcctttgactacaacttcttaataattttttcatgatttatagtgatctatagcaaaaaaggtgaacaattttcttagtttctattttcttggttgattttgttttgacctaattactttctattttttttccttcattgtttacaaattctcttatattatgactgttacataatttttcttgcttttggaatcacttcatctatatactatctactatattaacaaaaataatatcatttatcatgttctctgagtttaggtttcacaagcttattttgttctttatatttcattatccttcgttaggaccagacataatagagctgtcatgagaacaaaagtgttaatgaataagaaaatttaatgaaaaaactaaccttagtatcaagcatgatgacatagagtatatgattatacgtgccatgagagaaattgaaacgagtaacgttcatgtctgcttaaagaagcttcctagtcatttccacatggcttagtcagttattctcgcagttcagataagattcggaccgccacttctctgaaagcatggttcttgccttgtctatcacaaattcctttacttaggtttctcaactttatgctatgaccatactaaactacttataaaaataactttatattatcattccaatttatattttcttatcaacgactttctttacttttacaatttatcataattctaacaacatgtccaatcatcacaacacattctttagatctttactatcatttagttatttacaatttcaaaataatagcttcacatacaaatatgttgaatttaacatatttatatttataaatttgtaacaatataattaaaatataatataagacactggaataatttttataatttttgtttgtgaacattttcaatcattattcacataaatttacattatttaatagattttattattaaactcaaacaacacacactcttcagatactagtatatagtgaattaattttcttagttatttataaggacccctaatcatatattgaacaggattcgatcgagcaaagtaaaacactatttagaaccactttggattatcaaatctcatgccaaaaatcgatcatggaatgacatccactaccaaattaacataaataataagattattttattatttttatcgataaatattatttgttgaagtattaatttttccttttttttttaatcagccaaaaaagattaatatatatatatatatatatatatatatattaataagtgataggtatcaatgataccaaacgaaagaaacagtacaaccatagaaacaaaagaacactcatgcagatgcagcgccatccctacgtagcataacctatgtgatccccttggagagattcatgtgcacaataacgtgaacttcaacgagttttattagtttttgttagattcaaattcaaaatttctttttttttttaatttttttaattactaagttgacttaaatgaagaaaagaaagaaaacaaaaatatagaaagaacctctcttttgttttgttcctctactgcctttaattactaagttaatcttatttaatgaatttatttatgatttggagcatttaataaattctaataataataataataataataataataataataataattattattattattattttgacatgaatatgttaaaaactgttatgctagccctgatctccgctactgagtgtacgtatatttaattactatttataacaattcttcgtgtacgttttttatgttttttattttaacaaaaagtattttttaactattgcatttgcaaatgcgtgaccaatctcagatattccctttgtcaatatgtctagtttaattgattgataacatatatgaattattataaatttattaatactgttttgatttctattaataaaaaaatttcattctccgtacgttttctcgtgggtgtttcaatgaattactgcagaagaataagctgttgataactaattaacttcaaccttgatatttttggacacaactcacccatgatttaagcaggtgtttggatgtgaagtgtgaactacgatattatgtctccattatgagttgggtatgaaactgtgaaagctggtacactatgtttggtagagatataatagatagaagaaacaagaaaatgaggatgatatggaataaaaaatgatggagtatatttgataaaagagaaataggtgaagagagaattaaaaagatatatatgaaattaacgatgactagaaatgaatagtaacttctccccctctctaatttgtatttctcttaaatgaaatttatattttttacttagtttgtggggattagcgagactcagctatcatgacactgttaattaacttactctcaatttaatattatctttcttcgttgtacaatgatatgatagcggtggttatatatttattgtatatttatctaacttccgttgacgcatttatactagttattgtcaactactccaataaccattgaattcaaagcaagactagatgcattttattatcgaaaaatgtatgaattttattaaactcactaccacaaccagaaatcaatgaccgtaaatttaggaagacgcaagctacaatgggagagtgtaatgggtctcttttcagaaagtattttatcaccatcagattactttgtttaaaaatcaatgaccgtaaatttttcttcttttattattatttttccttttttgtcgtcttctttcctgtactacccttttcctctttcttcttctcttctttcccattcttcctctcttcgtctaagcggcaacggtggtgctatgacgaccgatgatagtggggatgttgatgcgtcgttgcctgaccgttgtgcggagtaaactagaaagaactcgagaggatctttcgccatttttcatgcggtgttctgccacaagatttcaacaggagaaaaagcatggaagacgaaacagtcacaaagcttgatataattattgcctcacttaaacccaaattggattcatttgaacaaacccagattttagtctcccaaagttttgagctttttcatattttttgtgtacgtgttgattttttctcatgggtgccaagttacgagtttgtttcttgcataaatgttgtttctataccattttactctcaattttgagtccaatttggaagaataaaaaacctaagattttggtttttaaaatcatgacattttttatgacgatttgtgattatatttgaaattgcagtttcaaggaaattattgtaccgttgatatgtaatatttgtaacctggccttgttttctctgtggctcgaccaccgtagtgaccatctgtggatgtggaatagggaaaaaggaggaaagggaagggttgccgaaaattactttctgcgtaggtgtcgttgtcggatacaagaaaaatggaagaaaagaaagaaatcagcaatggtgatgaataaagccagagggataaatcgggaaatcaagaagaaaaggaaaaaaattataaagaaaaaagaagaaaaaaactcatccatgggattaaaatttaataactctaatggtggaaattcactttcccattgtggaagacatgttatattctcccacgctagtctttgacagattacggattaaaatgtatattatgaaagatttaatactaaaaataatattcaacaaagtatagagtctaaacatatattttactcaaaatatttcaaatcttgctttgaattagttgttgacacttgacaccttgtttcatactaaattgtccctcatagtcatatatgcaagatgtaactatatatataaggtttaggatttaggatttaaatcatggacaataagaatcctaaatcctaaattataaaccacatggaaagaaaaagactttgacatggtgtatgtgtagtttacggaaaagataacatagattaattatagtgtgtttggattttggctttaaaattatcatgaaatatgatgagatgaatcaaatttaattttatctaaaactagttaaatggctcatgactccacctgtagtaattttacaatttataattttttatatatttaattattatattttaattaatataatatattattattaatatgttagtatttaagttaacatttttattatcattataaaaaatatttatgacaatttaataaaaccacgataataaaaaattaccataattattacaaaaacatattagtgttaattaaattataatccatattatcccatgcatcaattatttttagactataaaaatattcctaattaaataagagagaaattatattagcatatatatttagaagagagaaaaacattaatgacaatagtatttttgaaaacatattattttagaacaattttttttactatcaacttagttaattattttttttaatcttaatggattagataattaagtcttataaataggaataaatagtataatatagtagatagtagattttgcatgtttagttattttagtctaatcaattttaattgaaaaaaatatggtgggtggaattaaagtaggaataacttctacttctatcaaaataaattctagttagattttgtctaatttactttcacatcaatactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattgaaaaaaatatggtgggtggaattaaagtaggaataacttctacttctttcaaaataaattctagttagaatttgtctaatttactttcacatcaatactctcatacgcatatgtttgtttttttttattgatttaaaaacataattaaaattcttgcaatatttatagattctagttgttatgtttttttttattgaatgtattttatctaattattccttgtactcataacataatagtgtgataaatcatttagtaaaaggaaatattatatttcagtttaactattggcacatttgggtttaattatatatatatatatatatatatatatatatatatatatatatattatatnnnnnnnnnnattacaccatcaaaatcaatttaattcaaacaacaccctcttaataaatcacttttatgatgtcgatggagtatggtttgatccttccaagtgttttgttcatcttttcatcaatgatattttagagagaacgatatagtgttaataagattaaagtgtcaacaggattgagatatatgaatcccattagctagacttttgctccccgtttcttaaaaaaaatcatttttctgatgattgtatgcacttgtgtgaattttgttagaaatatattcccacataatggaaatatgaacagttacaactattgatgtgaatagtnnnnnnnnnntccatcagaaaaacacagaatagaaaagaaggcttagagagagaaatcgccctaccagtgttggtaaagaaagagatgactgttactccatcattagcgcttccgggtatgttttttttccttcttttattggtgagaatcatgatttcccaagatcctttatcatgttcttgctttatgttttatgaacatgatatattatgttaatctaacatgtggtatcagagcatttgtttaggaattcatgattttccttatataatgattgaatataaatgtttatttgtcatatgcgtatctgtttgaatcctacggacggatcaattggtaaacatgatgtgtatatgagattgatactatttatgtatatattttatatgatgtgttgctccttttgtaaaataaagatctataattataagtttacgtcagcaagctttattttacaattggatgataaaatggttgttgggattgatgactttaattgatgataaatatttgtaccaaaaattatgtattgttaattaatggagtatgtataaaggcatgacttccgctgtgtctatataatattttattttaaaatatttattgatgaattatattatgattatagcatgaaattatttgatcggttattttcacgcattatgtcatggtttgttagtcaccaaagtggccaaactagaagtgtgaaaataatgtgatacttatgtatttgcatgcattatgattataatttgttagtcaccaaagtggccaaattagaatgttatcgcatgcataaaattgtcatttatccatgtacttatgaaataccaattattgaaataaattggataaattgacattgctaattattggaaaggaaggattcacccaaaggagaatcatattctataattagtgacattatgtggtaaattaatatttttaattaaatatattttgattatccaaagataatagatatatatatttaattgaaaatatgttttgcctattaatgttatggtatttaattatgtttagtatattatagtaactacccaaaggagtgctattttatactagtatgattttattcgaaccgcaattaagagcgtatgttattattgcgactgttcctatggattctcatgcatcatctgttactatgtttattggtgagaattttctaaatggcgtgaacaagtcaaattccacttaggtgttatggatcttgacttgacactccttgaggatacccactgctattattgaaaccagtagtgaggcagaaaaattacaccataaaacatggaagcgaagtaacagattgagccttatgttcattaagatgactgttgccaacaacattaagtcaactattccacaaacagaaagtgctaaggaatatatgcagtttgtggaagaacgtttccatgcagcaaaactaaagaccttgggacttacggttgaggactcattcttagttcagtttattttgaactcgttgcctcctgaatatgggtcatttcaaattaactacaacactattaaggataagtggaatgttaatgaattggccagtatgcttgttcaggaggaaggacgattaaggaatcatgcgagtcactctattaatctcatgggtcagaaagctgggaaaggattaaaagcaaagtcaagacacttttagaaaaagaaagcacctgtgaaagatgggcaggagaaagaaaagaaggaacaaaaggacatcaagtgccacttctacacgaagtttggtcactatcaagttcaatgtcctaaacgtatagcttggttcgaaaagaaggataattatttatctttcgtaagtttcgaatcaaatttagttgaagttcctaataacacttggtggcttgactctggtgctacatggttttcaatgttggtttaaaacgtggcatcgagaatgaaagttctgctttcttgtggcataaaagattaggtcatatatctaaagaaagaatcatgagattggtgaaggatgaaattttgccaaatttagatttcaatgaccttgagttatgtgtggattgcattaagggaaagcaaaccaaacataataagaaaaacgctacaagaagcacccagcttttagaaattatacacactgatatttgtgggtcaatggacactccgacctttaatggagaaaagtatttcattacctttgtcgatgatttttcacgttattgctatatctacttgcttcatgaaaaaatctcaatcagtagatgtcctagagacattcattaaagaagttgagaggcaattggatagaaaagtgaaaatcgtaagatcagatagaggtagtgagtattatggcaaatataatgagtcaggacagtgtccaggaccttttgcaaaattcctcgaaagacatggcatatgtgcacaatacagtatgccaagcacaccacaacaaaatggtgtagcagaaaggcgtaatcggacattactaaatatggtaaggagtatgataagtaactccacactacctagaaatttgtggacttatgcgcttaaaactgcgacttacttgcttaataggattcctagtaaggcagttcaaaagactccttttgaattgtggacaggaaggaagcctagcttgaagcacctgcatgtttggggttgccaagccaaagcaagagtttaaaatccacatgaaagaaaactagactctcgaactgttagtgggtacttcattggttatcttgagaagtctaaaggtatgtgtttattgtccaaaccatagtccgagaattgtagaaactggtaatgcaagattcattgagaatggtgaagttagtgggagttctaaaagggaagttgtggaaataaaggagactttgataaatattcctttgcctgtaattgttcctccttccacaatttcgcctaatgttgttccaatcgttgtagaacatgataacaatgatgaacaacatttgaatgaaacagttctcccggaagatactaacttgcaaaatgctaatgcacaagaaccacaaggaatagaattaagaagatcccaaagggaacaaaagtcagctattccgaatgattttgtggtttatttgcaagaattagatcatgatgttggaatctataaagatccagtttcgttttcacaagccatagaaagtattgaatttgaaaaatggataaaagctatgaaggaagagctaaaatccatggaatagaacaatgtctgggaactcgttcaattaccagaaggttctaaaagagtcggttgtaagtgggtctttaagacaaaacgcgactctagtggtaatgtcgaacgatataaagccagactcgttgccaagggttacactcagaaagatggcatcgattataaagagaccttttctcccgtctctaaaaaggattcatttaggataattatggcattggtggctcattatgatttagagctgcatcaaatggatgtgaaaacagcctttcttaatggtgatcttaaggaggaagtttatatggatcaacccgaaggtttttccatggaaagtgaaagaaagttggtgtgtaaacttaagaagtcaatatatggacttaagcaagcctcccgacaatggtatataaagtttaataccattgttacatcttttggatttaaggaaaacactgttgatcggtgtatataccaaaagatcagtgggagtaagtttatttttatagtcctttatgttgatgatatctcacttgctgcgaatgatttatcgatattgaatgagactaaaaattttctctcaaagaacttcgaaatgaaagatatgggagatgcgtcctatgtgataggaatagaaatattccgtgatcggtcacaaggattgttaggactatctcagaaaggatatattgagaaggttcttgagagattcaatatgagtaagtgttcacctgggattgttcctgtacagaaaggtgataaatttagtctcatgcaatgcccaaagaatgatgttgaacgaaaagagatgaaagtaattccatatgcttctgttccgggcagcttaatgtatgctcaaacctgtactcgactggatatcagttttgcggtcgaaatgttaggcatgtatcaaagtaatcctggaatggaacattggaaagctgcaaagaaagttttaaggtaccttcatggcacgaaggattacatgctcatgtacaaaagatccaatgaattggaagtgattggatatgcggattcgaattttggtggatgtcttgatagtagaaagtcaacttttggctacttgtttatgttggctcaaggagccatatcatgaaaaagtgccaaacagactattattgcttcatccactatggaagcagaatttgtggcgtgttttgaagccacagttcatgcattatggctgcagaactttatttcagggcttgcggttgtcgacaccgttagcaagccgctgaaaatttattgtgataattctgcagcagtattcttctctaaaaatgacaaatactctaaaggtgccaaacatttagagttgaagtattttgtcgttaaagaggaggttcagaaacaaagagtgccaataatgcacatcagaactgaacaaatgatggcaaaccctttgacgaaagggttgcaaccaaagctatttcaagaacatgttgaaagtatgggccttggttgtattaaggattattgatatgtgacattctgagctcacttatgtgtttctgacatacattatgttttcttgttatattatgattgtatatacattatgaaatataacaagaaagtctttgtaagacattatgtggaccattatatttcctatatattatgaatgatatgatgagttgttgatgacgtagtatatggaagggaatgcgttgaattaataatgcactaccgccataactcgcatttgacaacttatcattttatgatggccaacgcaagagatgtattgaacatgcatattatgattaatcgggccaagtgggagaatgttagaaatatattcccacataatggaaatatgaacagttacaactattgatgtgaatagttacaactattgatgtgaatagttacaactattgatgtgaacagttacaactattgatgtggcccaattaataattaaccgctacaaaacggttacaaaatgcattgatctcaagcgttgatatggtatatgatggacgtaccagattaaagacaattatgtataaatagggttggtcctctctctcctttacaccaagtgttattcttccatcagaaaaacacagaatagaaaagaaggcttagagagagaaatcgccctaccagtgttggtaaagaaagagatgactgttactccatcattagcgcttccgggtatgtctttatccttcttttattggtgagaatcatgatttcccaatatcctttatcatgttcttgctttatgttttatgaacatgatatattatgttaatctaacaaattttccatgcctttctttaatttgctgacatgaggggattagagcttatcattagcaaaaaatggtttatcgtccaaagaattgtagtttagctaactaagagaaattgaatcacataattaagacgagaaagagattatcttaggatggaatcaagggaatttcaacaactaaccatttttattaattgatttttctagtacattcaattgtgctcttgtttctttcagtaaataaaaaaaaaagtccaaaaattcctaattttttatctcttaaatcaaaagagtaatcgataatttgattgattgtatatttgataaatcaaatgttttttttttcatcttgtccttaaaaaataaacgaaggaacatttgtttgcatcacttggtgcatcaattggaaacatttagctatttacgcgtaaatacaaaataatcaatacgtaataactccaatggtaacatttattagtagtcgttaatattgaaataggatgccaaatttgtacagccctacaccgtatgtaccattatacagtgtagctgcatttattccatacaatacatacatataacatgcatatttaatactaccttagatttttttataagaaataaattttagtgtaaaatacactacaatttatttctcttacattaccttcgaaggaatatgcaatacatacatacatatatatatatatatagtcttgatatatatactaaaactttcaccttgccaccacatttataatcttctgtaacctgaaaaaaaacatgaaagacaagacacatttaataatcccaacagataacgacaccatggatatgaatgcccaaaatatttggtcatggtagtttagtaaagggataaattatcttttcggtccatatattttttaataaaacttgatattagttctcaaattttagtcttaattaatttaattcttgaattaaaaaaaaacaataatttgttcctcctcagaataaaaataatgatgaaaccagtattatttttctaaggtttaaagattaatttgatcaaaataaaaatatggaaactaatactaattaatatttatcgagagctcagagattaaaaatatgccttattaaggctagaccgacaccgaaagaggattaacactgatgggcttgaattcgaggacgtccttggggttcaacaatggcctcaccaacaccttcgtttcatacacatttttggtttcacaattttttgcttccaaagcgatgtagaatatgaacccttccaccacctgctgctttgcactaatcaccttcacaaactccagatttgcattctgcatttccaactccaatataatcagcacaagtaaaaaaaaaaaaaaaaaaaaaaaaaaaaaaaaaaaaaaaaaaannnntaaactaaattaaacatgcatattaagatgttaattaattcttaagttgtaaagttgaaacttaaaggaagaaaagaaagaaccttttctttgttgtgttggtcaacagcaaaacgagcgagattgtcgacctcgtcgctatgaggaggcacaatatgggtaaaggcaccaaatattggtttaggattgaattctagcaactctttggagttcaaccaattcctcacccaaaccttcgcttcacactcctttttaatctcaccatcttttgcctccaatgttatgtagtatttggacccttccaccagttgcagctttgcactaatcaccttcacaaactccagatttgcattctgcatttccaactccaatataatcagcacaagtaaaaaaaaaaaaaaaaaaaaaaaaaaaaaaaaaaaaaaaaaaanaataaaactaatggcatgcaattaaaaatagagataaattaaattaaacatgcatattaagttgttagttaattcttaagttgtaaagttgaaacttaaaggaagaaaagaaagaacctcttttttgttgtgttggtcaacagcaaaacgagcgagattgtcgacctcgtcgctatgcggaggcacaatatcggtaaagccatctattattggtgtgctaagcttaaattctagcaactcattagggttcaacaatggcctcaccaacaccttcgtttcatacacatttttggtatcaccatgttttgcttccaaagtgatgtagaacatgaaccctttgaccgcctgctgctttgcactaatcaccctcacaaactccaaatttgcattctgcatttccaactccaatataatcaccataagtaagagagagagagagagagagagagagagagagagagagagaaaactaatggcatgcaattaaaaatattgataaattatattaaacatgcatattaagatgttaattaattcttaagttgtaaagttgaaacttaaaggaagaaaagaaagaaccttttctttgttgtgttggtcaacagcaaaacgagcgagattgtcgacctcgacgctatgaggaggcacaatatcggtaaaggcaccaaatactggtttaggattgaattctagcaactctttggagttcaaccaattcctcacccaaaccttcgcttcatactcctttttaatctcaccatcttttgcctccaatgttatgtagtaattcattccagaaaccacttgctgctttgcactaatcaccctcactaactccagaactgaattctgcatgcatgcgtttccatctccaattaattaaatcatcacaaataataataataataataataaaaggagaaatgcatttaaaactagataaaactgagaaataattttgttattaagtatttttaatgttctctaatcagaaatggtattttaatatcccacttaataaaagtttgtgttaaaaattagcataagttagtaagatatatatattaataagtgataggtatcaatgataccaaacgaaagaaacagtacaacaatagaaacaaaagaactccatgcagatgcagcgccatccctacctgcttgcattggttattaaacatttttgtcatcaaagcaaccgaaatgtagcataacctatgtgatccccttgtagagattcatgtgcagaataacgtgaacttcaacgcgttttattagtttttgttagattcaaattcagaatctctttttttttttaataattactaagttaatcttataacttctaaaataaaataaaaagataatcctaattcttaagttgtgaagttgacttaaatgaagaaaagaaagaaaacaaaaatatagaaagaacctctcttttgttttgttcctctacagcaaagcgagcgagatcgacgatctcgaggctgttggaagctccaggcacatcggtgatgtcacctaatgctggctgttttgtttctgttgccatttctcttttctttatcttctgtacaccatgactgtactctattctaaggctttttatagggaaaatatcaaagtttatcttatctattctgattgactttgagtggtcacaaaaaaagatccagagaatgaaagatgaaagtttttttatcttacatcttatttaatgaatttatttatgatttggagcatttaataaattctaataataattattattattattattattttgacatgaatatgttaaaaactgttatgctagccttgatctccgctactgagtgtatatttaattactatttataacaattcttcatgtacttttttatgttttttattttaacaaaaagcattttttaactattgcatttgcaaatgtgtgaccaatctcagatattccctttgtcaatatgtctagtttaattgattgataacatataagaattattataaatttattaatactgttttgatttctattaataaaaaaatctcattctccgtaagttttctcgtgggtgtttccatgaattactgtagaagaataagctgcagataactaattaacttcaactttgatatttttggttatttgtggacacaactcacccatgatttaagcacgtgtttggatgtgaagtgtgaactacgatattatgtctccattatgaggtgaaagctggtacactatgtttggcagagatataatagatagaataattttttatttttatttctcttaaattaaatattttttttatttttatttctcttaaattaaatattttttatttttacttagttttcacctatttttatttattatatttttcttttctccaattttatcaactgtatttctcatttaatgtatttgtttcgtacgtaccaaacaatccgatcgaatgcaaaaaaaaaaaaaaaaaaannnnnnnnnnnnnnnnnnnnnnnnnnnnnnnnnnnnnnnnnnnnnnnnnnnnnnnnnnntgctgattcgtgaccatgcacgttttttggatgtcaaaattagatatattagatgcatgctctttacaaataatcatgatcaacataaaatagataatgtcaaaaagaggtatattatacattagtagcaccagaaaaataaaaaggcgtcagaataatcatcaaccactagattcagaaacaaggcttatagtaatgagttgatggatccatcataaaatgtatttagaatagttgtggaaaaaatattgttttaataattgattatatgaaattagttttgtgattagatgtattatatggaaaatgattatgagataatttattttattttaattttttaaaataaattttaataataaaactataaaaatatatgaaactatttgtaatggtttgtttctatttaaaataatcaattgttaaaaataaaatgagaaagcaaaatttatctaaaaaatgaagtgttaacttataattataaatttaatttttgttgcttacttgaatagggtaagaaagttctctttgcaataaaaaaaaaaagatacatttgaaagaacttatttgggtttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttatttcaatagtttgtttataataacttacaaaaaaacatataaatagactcacttaaatttatatttgatttaaaaagcaacttatatataaatatatctataacaaattaacaaaatcttactcagtacatgaataatcaagaaccaaatatagactatgatacccatttaacattgtaattcctataatgaaaaatgctaatgacaatttttcttttagatgttttttttttgtaattgattaaagtttattgaaaatcattaattttggtggatttcacaagttgtttaatgattatctttcctaatttaattgagagacctaccaaaattaataatttttaataaatttcaatcaatcataaaaagaataccataaagagaatattaaagggagtgtcactagaactcttcgtaatataatttttaatgcttctatgaaataagaaagaatatataattttacataactttttattaaatgaattttacacaccgattagaattcataccacacatgctttgaagaagtttttcactttttgccttttaggagtatcctataatgatttttggatacttattcacttcaaagttcaaacatctaattcacatggattacctttttctttattatattatataattatatcaatcctgttacggataaaagatattagtttgttatcctcttatttgaagtagtcaaatacccgctactggcccacgataaccacccaggaaggtgggatatggccgttgtcttccactaaccaatatctccgcatatcaaggaacattccgttgagcataaccgtccggccagcaaagtccaggtacatcctataaatacagaacatttcatggtgaaaggtacacaattctgactctctctttccttttacacaagcacacaccgcacccccctacgtgtcgtgttcactgtgctgtgatcttcttccttgagttgctttccatccataagcttcttaagagagagagagttcgatcctacataaaatcacccaacatcattgttggacatttatgttctcctcgagcagaacagtggcgccgtctgtggggacgataaatttcgaatcccaccacctctcaatggctaatcctagaagaaaccaacatgtcagacgtgaagacccacctaggaatccgattcctgaggaggtggtggcggaagacgcattgtcccacacagcttcgtctcgtgcgggaccaacaatgcaggtgccggctgacataccaccggccgcgcaagaagacccagaaacttctcagcgtttcgtctagaacgctctccaatccttgttggctcgaatggagaatctggagaagcgttatgaactccaacgccaggaagacatccaacagctgatcgctcagttggaagatcgcgacaacagaagacgtggggaggaacgtcggcacaataccgacgataggcgcgaagaagatcggcgacaggatgtcgaccacacagaagaccgtgtaggagttgatcatgcaacagcgaggaggtcgaggccatcaatgtcgatccgagcaaccgggacgaacaacgagagactgctgaccactccgtgcaagaaaaaacgtttcgcccacatgaggctcatcgctcgtcggccatttcacataccgcagaggaacgaccgacgggggagatcgtccgtcacctcggtcaaggaaatggtacgtacaagaggaagtatagtcggggccactaaaacaacagcccgttcgttgatgagatagtcaacgccccgtttttggaagacttcgatgggtctttcttgaacaaatacaacggaagtcaagacccacaggtacatatcgacgagttcgatatgcaaatgtgtgtacggggaatcgacgaaccgatcatatctcgaatcttcgggacgaccttaaccggagccgcccagacttggttccattcgttgccgccgaggactattcgcaatttcgaggatttcggccagaagttcttgctaaacttcgccacaagcaagaagcagccaaagtccgagttcgctttggggaagatacgccaacagaacggagagacgctgcaaaattacttagatcgattcaaagaggccgcattgcaggtgcacgggttggaagagaatgtccacatttaccttttatcggccggccttaatggggcttctcgactagccaagtcaatctacaaggaccctgttaagtccctgaatgagttcggcatccggtccaagaagtatctggagttggagcagatggaaatagccaactcggctccgagagagaataagaaaccgccttcgccgcgaaaccgacgaccagataacttccaagtcggacaatctagccgacatccggctactatcccggcaggccgacctccgcgaggatttcctgacaatcgtcctagaccggggaaatacgaatcgaaattcgaaagatacactccgttgaacgctacccggggacagatttggaaagaagtggccttcacggaaatgagaaaggtgaaccggccccctccagtagtgcgaaaggaagggatggactacactcgatactgcgattttcacaatggaccgggacatacgaccgaccagtgctgggaactccgagacgccatagaaaggttcgtgcgtgaaggcaagctgcgccaatacgtgatccgaacccaggggcaccaagccaagaaaaaggcccaacaggagaataaaccacgggatgacaagaagagtaagaaagatgacgaattcccagaacccgagttcgaatgcaacttcatcgcatgaggactaggaggaggaggcgacacggccaatcaacggaagaaatacctcaaggaggtcatgtccgtaagagataggccaagattcaaggagaccggtggcgggagtaataaaagagacgctcccccgctgatttattttaccgacgaagatttgaagggagtggtgccctggcatgaagacggccttgtcataaccggaactgtcgcaaatttcagagtcaaaagaatattcgtcgacaacggcagttcggccgacatcatcaactggagcgccttcaaaaaattaaatttgaaggaggaagacttgaggccatgtcaaactatgttgtatggtttcaacggggaaggtaccggcttaaaaggggtgattgacctccagctaacgctgggaacgaaggagggcttcaggtcggaaaaagtgacgttcaccgtcggagatttcccatcaccgtataacatcattctgggaagacccacactttataagtgggacattctgatgtctaccaagcaccagaaaatgaagatgatagggcacctcggcaaagttatcacaatttgtggagatcaaagagaatctcgacagtgttactataacacgatcagggagacagaaggcggcccatcatccccacctcggatccgacaaggagaacaacgagaacacagggccgatgagtacctaccccggaaaccaatcaacttggtggaactcgatttgcgagacatagaggaatggagacccgagccagtggacgaactcgaggacgttcagatcggcgtctccccagttcaaatcaccaaggtaggtaagcaggccgacccagaaaacaaaggtaggcttatccaatgtctgaagaaaaatcaagatgtctttgcttggaaggcatccgagataccgggaatcgagcctacattttgctgccacaagttagcaatgcatcccggttccaaacatgtagaacaaaagaacagaaaactcggttcagacagaaaacaggtgttgaccaagcacatcgaagaattgctcgaagcgggatttatcagagaaatccagtacacgacctgactttccaatgtagtgatggtgaagaagcccaacggaaaatggcgagtctgcgtcgactacaccgacttgaataaagtctgccccaaggactcataccccatgccgagtatcgatcagcttgtggataactccgccggttttcagctgctgtctttcatggacgcttactcggggtataatcaaatacccatgcaccccgacgacaaagagaagacggcattctgaggtattgatgctaactattgttatgatgtcatgcctttcggtttgaaaaatgcaggggcaacttaccaaagaatgatgaacaaagtcttctcggaccaaatcgggcgcaacattgaggtatacatcgacgatatgatcaccaaaacgtcggcctccggagaccacgtaaaggacttggaagaaaccttccagaaactgcggcaacacaacatacgcctaaacccgctgaaatgcgcctttggagtaaaagccgggaaattcctaggtttcatgctgactcacaggggaatagaggcaaacccagacaagtgcaaagccgtcctagatatatatgcagtttccgaccaacaagaaagaggtacaacaactgacggggaggatggcggctctgacccgattcttgccgaggtccgcagacaaagcccttcccttctttaagctgctgaaaaaagaagccaagatcggatggaattcggcatgcgaggaggcattccaacagatcaaaacatgcctagcctcacccccggtattatcaaagccacaaccgggagaggcacttatcttatacctctcggtcggcgacgaagcaatcagtgcagtcttggtcagagaagtagacaaaacccagctcccggtatatttcgtaagccgagctctcaagaattcggagttaaggtatcaaaagctcgagaaggtggccttcgctctactcactacagcaaaaaggctccgcccttatttccagggccacaccatcatagttcgaacaaatcaacccatccgacaggtactacacaagccggatttggcaggaaggatgatgaattgggccatccagctgtccgaatttaatattcagtacgaagcccgccaggccattaagtcacaagccttggctaattttatagcggaactgacaccgacagcggcggctcaacagaatcagatgtggaaggtatatgtcgacggcttatcgaatgcgaagggaagtggagccggggtgatcgtcgaaaatcccgacggagtatccattgaacagtccctccagctcaactttccgacttccaacaaccaagcagaatacgaggccctgattgcaggattaaaacaggtcaaggagcagggagcaacaagggttaacgtcttcaccgattcccagttggtctccgtccagattgaaggtaggtatcaaaccaaaggccccctattagccaagtatctgacaagagtaaaagaaattatggcagaattcgacgaagtcatagtagcccatatcccgagagaggaaaacgcccgagccgacatactgtcaaagttggctagtacgaaaggggcagggaaccataggtcggtcatccagcaagagctcgcccaaccggcatgtgtcatgatcatactcattgccgacgactggcgaagacccatcgtcaactatctagagcaaggaatcatcccagacgagaagctagaagcaaagcagctaatccgagaagcagctatgtacgtcatcctcaacggagaactataccgacgaggcttacatagtcctttactattgtgcttggactcaaagcaagccgagtatgttctctcggaagtacacgaagggatcaacgggcaacacatgggggctagagcgttggcactgaaagttctccgcgcaggctatttttggccgacgatgagggccgacgcggcagaacatgttaaaaaatgcgatacatgtcaaagacacgcaaaaatagtgtggattcccccttccgagctcagtctgatcacttcaccatggccattttacaaatgggacatggacttgctggggccgtttaaagctacagagggttaaatgcgatggtcagtgtatatagacattcaaatccattttgatcattacaccatcaaaatcaatttaattcaaacaacactctctcataataaatcccttttctgatgttgatggagtatggtttgaccctctgttttatacatcttttcatcaatgaaattttagagtgaatgttatggtgctaatgagattggggtgtcaatagaattgagagatggatcctattagctagacttttgctccccgtttcttaaaaaaacaatttttctaataactattatccaaacaaaaattacattactgtataatcaattctaaccataattaattatgtaaaatcattttgatgtccgcctttaagcatattctacattcatcttctatttccaaatcgacattgattagttttccatctagctccttcaatcatcttcttgcctaaacttgaaccatctacctatagtgctcttaatttcttacaaatctccaatttctccgccctaccatgaagttgttggagagcagcaacaaacaagtgtcaattacaaacattgacaaaccgcaaacctatacagaagcagaaaaagaactgaacaaaaacaatgaatcaacagcttaatattacaagatctgaaattaaatatccatccaagatcttattttgaaacttttatatacattatgatgcccgggtaaatccataaaattaagcttttcacaaccattaaattcatttgcaaatcatggctacatctttgaaaattggattacctgttttttttctaattgtatgtgcctgtttgctcttccattttctccgtatagactacgaatgttacagtggaacatgagtagcaatatagagaaaaataaatgcaaactaagtaaatgataggataaaacaaaacaagagagatcaaatttaaggtattgtgtttgtttgaggaagatattcgcacacgaggttgcaaccagtattacaaaaaccatcttcagattggcgattcaactagtcaaatacatgtctgaatgtctgatcagtaggctactgaatcgatttgcaattggtcaatagactatcttttagtttctttctattcacaaactcttttttagcttagcataacttgaaactaattcttttaaactaattttggtttagtttggttcacaggaacaattatctctctgttttggttcagagcaccaaaacagttcagttccattcaaagcccaagtatagaaataaattctatgcacttgtgtgaattttccatgcctttctttaatttgctgacataaggggattagatcttatcatcagcaaaaaagggtttatcgtccgaggaattgaagtttagctaaataagaaaaattgaatcacataattaagacgaccaagagattatcttagggtggaatcaagggaatttcaacacctaaccatttttattaattgatttttctagtacagtattcaattgtgctcttgtttctttcaattaaatataaaaaagtccaaaaattcctaattgtttatctcttaaatcaaaagagtaatcaataatttgattgatgtattgttgataaaccaaattttttattgatacaataacttctccttattttatcaattgtacaactagtacacttgtagtattctcaacaaactacaacaatatactggtagaaggtgactcagttgatctataattcaataaattaggcgtgctcagtcacgttcaatttagacttgtttgacagctccatatttataaatagtttcaaaacaactccaaatttataatttttttgcctgctttagggaggttctatgaattatctctgatttatgattatttgtgtttatgtattgcagctaaagcactagagttatttctgcaagatttgtgtgatcgaacatatgagataactttgaggaggggggcaaagactatgaatgcttttcatttgtctatgtcaagtctgttcaaggtggttacaaggctgcaggttttcttttggaggccggttattactatgtacttataagaacaccagatccgcaattctaatgataatatgcacaatcaaacaatttccttcctgtgccttctatttatcacatgcacaaacatgattagacatgtaaatgacatctgcagaagaaaatgttgggatggtcttgctttgggaacatgttttttgttctagtgtttaccttcactttccagtttctaaaatgtctgagttacttcacttacttgcatccttgcctttgcagaaaccagtgtgtgcagacttttaatgtctttgattttctgaaagatattgtcagcaaggttccggatttaggctgttctgttgtaactggtgatgaccatgctgtcactaagaggaggtttgtgctctggttaatactcttgttacttggaacaagttttctgtatgctgaactttgtttactttatattaggaatgttgccggagatgatgataatgacagcgacgaggagctcaagagaaataagaaggtaatttattaactgtattcaattacttcatcagtggttagcttaaatttttcttgtgtgattgaaccttttgctgagtaattatctcttgtccatgcacactgtgaaccttttgctggatacaaaaaaatttacttcagtcaatagggaaacccgctagtggcttgtgaatgcaagtacgtctaaatgtctaatagtctgcgaggctaggccccacttcaacttaaagcttactacacaaaggaccaaaactgtctggttttctgaaaacttttgctgaaaactatagaattggcactaaagaacctggcagctgtttaatattaaatattatctgaataatggaacttttttttcccatgattttcacagccagagcctggacataacagtggcagaggaagggtaggggcagaggtaggggtaggggccgtggaattagaactgtagatcaagagatgagttcacatgccaagtgggaagatgattctgatgtattgaagcagaatgacaaccacactcaaaacaatgaaagcatggaaaatgtgccggaacctgaagtagttaagcagaggtttccagtaagcaaactggctgaagtgtccattctaaattttgacttaaatttggacccagatgaggatatggattcattagacacaccaatttctgtcccaactagttcatctgcaaaatcagtgtcagaagagaagcatgaggaataccctggatgccccttgtctgaaatggaaaaaatgaccattgatcccattcaactagccgacataaatggaagggttgatgaagttgaagaggattatgatgaagaaatgtagatgaacctgtgttggtttattcattacttctcatataggcccgtcattagaatgttcttatggggaattagagtagattttataggagcagtgttagatacttactccttagtagtttaggaagattaggagggatagggcattgaatactctccttataaccttgttttaggttaaaagtggagatatagattgttccaattagaactagccatttgccagtaatgttatgacttatgagaaattttaatctcatgtaggtattgcttatggtaggcactacattcagattttgggtgttttatggctcaaaattttacgaggatgcctatcttaattacacttgtatctagcggaactaactcactgctccggcaacatgatttgcatgcaaccttttgaatttttggtatcttgaacttattgcacgatgagacaagaggaaaagaataagacgttagacggattgaaataaataggaaataaagtgaaaaagatgtgttgtttagatgaataaaaatagaaaggaaataagtgtagaaattcattatttatgtttgttttggacaaatgaaagagaaaatactaccagatgaattgtttgaaaaaaattatacatttttttaaaattatttccatcatttttctaacataagattattaatttttattatatatataatatacttatttgttttttaatatatataagcaccactaatggctgctctgtaaaaaccaatctcgtctcagaccaatttgtttaagtttaaaataaatattttttaaataaacacttatttaataaacaaataaaattgatcaaattaagaagaaaaattattttttaagcacacacaatttagataaatacaataaaaaatacaaaattatttattttattaaataaatatttttttcacgaataaatttaaacaaatttatcaaagaacatcacttgagttacaagcagagttagactaattagtacacatgtcagataattataaataataattgaataatttgaataattaactactaaatgtggaacttgtgtctataccatgaggtgaaatatatctaaggaggtagaacataaactagattttgagtaaagattttgagttcaaaatctgatctttattaaatctccaaataaaggaagtgaacaaatcttaaacatagagaatgagttcttaaagaagaaccctcaataaatgcacattattcaaaaaaatattttttttctttttctctctccctaatagatctcaaaatgagatatactattaaagaaaaataggagagatcttgaaagatatttaatcttatatgacgttgtagaatctatcaaaaagtgatcttagatctctatttgaaactaaaattccaaagtacagttaacttggtcctagctctagatccacatgcttacatgcctccgtccctgattggagatgtatgaagtttatatttaatatggataagtcctaggaaacacataatagctggggggtcaataagtttggaatacctataacttcttattaaaatgccaaactaaatggttcttaacataataacagtggttgtgacatatactaagataggaaacgcacaatatatagtcttaaattcaaagacgagcttaattgtttcacaaacaaataacacagtgtggacactgtcacactgtctataaatatcaagatacagaaaatgaggagaaagttttagagtttgccagtgtctataactatgtaataagttactagagtttggatggaagataaaatctagaccataagtgtttgtcgaaaaagctaaattgaaagagaagaaacagaagaattgggaaaacccccattgaagccactgcataagaaatccacttggaagtgtgatcaaatatcagaaaggaggctgcagtgaaagccacaaccatagcagcaacggagataataagtaacgcacgcccaaaagtcaagctcggatggagtgatgtcacaaatttgccatcgttttttgcgagtcttgatgaagtgaaatttgacaagaaagatagtagagatgcagaagaagtgaataatgcgactgcatttgttaagatgaagacagtaaaccacgcattgttcttgttgtcacctggaacagtaagagcagcgccaaatgctaccgtagcaacaagtgctgccacaaccatgccatattcggctattcctttggctgcatctttaatttcgtccgacaacttcttgtgttcttcttgaaatacatcctttggtctcttgcccttgtgcttaatttatcatgaacatacgacttcactaactatttatcaatcaagagtatatgtcaatgacggtatccaaatatatatttgcccatgcattggttggcataaactaatgtcaatgcataactataacttaattaatcttttcacttttttttttataagcaaaatattattgataaagcttaaacaatatatgccttgattaatcttttaattacaactattttttgaagaaatcttttaatgacaacttaataactattacatgctaaacttgcaagaagtacaatttcaaacttaagatatattttctttaaaaaaaaaaaaactagagggtaatgttgaatattgttacagatgcacttctagtcttctgcccttctcctgtaattttcagtaaaatctttcttactacttattcattgtttaaagacaaaatttcaaaaaatattatagtaatgaacaattgctattttaattataaacttgttacttttgaacacttaaaattaaatcaatcttgttaagaaaaccctaaaatttatgcaatttttaaaataagattgctcgaactgatcctatacatataaaataaagaggaagatcgcaacaaagaatgatggattgatgggtaataataagcaattaaattgaccttgaaccatttgagctctctttgcatttgaatccttgctctaaaactggacaatgcttcgcattcaagtggcagatgcgcagcaaagtgtagaacattgttaccttcattgtcctttgccagttctaaatgctctattaattccgccagatccattcttttaagaatggtatcttttcgatatagaacaaccaagtgcagtaggttccgtccattattggggtcctttatgctcagtagctcacgattgttgtcaataagccaaaatacagccttagcgtttcctgattttactgcatcaaacagcactgtcgaacatatcaactccatatcctttttgttttccatttttcttacttgagtccataatattttaagcaattccagacccgtttgtgatgaacctcctgtattgttgtcctctaatttcgtgtccagcaataagcacaattgattggtccaagcaatgtttaaaatgaaaacaaagaaaaaaaaagttaaactaaatatttattcttatatgaaacacaccatattttttttgtttttatatctattttaaaaataaaatataactttctaaaataagaatcaatatggaaattatgccaaatacgaagatctaaattttatcttaccacacacataaaaaataaaaagtcattctcaacttgtgaaagcttacttggaaattccggtgacttttgcgccagcatatgcaatgctgtaaagttctcttcatttcttgccatggccaaagtagttggatatttttcaaacaatttcattgccacatctgttatatgcacaaattaaatagtaaaactcctactaaattgaaaaaccacgcacgagttcatatacgcacgcacaagttaaacaacatattaattaattataataagatcgagtaaactacaaaaacacttcttaaagtttcttaaaattacacacaataatatccctcattttttacacttacactaaacctctaattgtttgaaaaacattatattgaaatctcttacacattatattaatcttccttagttgtttgcaaaacattacattggatggataagggagctgctgtaatgataaaaaaggttggagatttattgtaaattcaatttaatcttataaaaatccaaagatgcggcctccggtactagctgggttctaaattgcttggggcaaaggacaaagtatgttgaatttatatcttgatctgatcagggtttctatcaaaatttgatatagatcatttgaatcaagtagtactttttagtctcttttcattaattcccattaactgttaattagaaaagctagctacgtataattgctaaaataaacaattatatcattcacgttaattactcataaaaaattactataaaaattaattttaaataagaacgcaatgagaaattggacctgttgggttttaaaggatgatatcacaatctttcaaaaacctaggggtcataatataagtatttctacagttctctactgatcattaaatttgttattgaattatggtcaagtaaaccgaatgacgttggaattgaaaacctatagcttatatatgatcagctcaattggttcatgaattgagattgcatgtttagttttacactcaccaaacatgttgctttctatggtcataaaaaacagtcgttcaatatccttggaagccattttgtcaagcacattctcagaggacaaaacttgcaccgttttgttgtcgccatataaagcagccaagtgaactggaagcctctcttgtgagtttggtattagcaggtcttctgggttcataagcttaactaaccctttcacacaagtaatgttccctccatatactgctacatgaagagctgtgtctcttctactatcatttaacggaatgcgtaccatatcaggatatttatcaataaccgtttgtgcttctctccactcaccccataatatatgtttgcacagatcatcttttaaagtacctgcaatcctttcaaacttcacattataacatttaattcctttatttaatcttaaccacatattatttgcaaaaaagatgaccctttcttgtttaccataaatgtgtagaaattcttcatatagaaattgtctcaattttgaattcctattaatttcatagtttgtaattctctgtttttcaagacacccttattgaaatctagctgagaaattggagatcacgggtatgtttggcccaactttttttctacttagaagttatttttagctaaaaattagaactgaaaataaaagataaaaactgattgttgtttttatttttcagcttaaaagttctttttaaattaaaattttctttacaaaagaatttaaaagttttaattttaatttaaaagtagttatctcttacaaaaaaaatacacttataaaattaaaaaaatattgtataaattaactaaatttatataaaattactttgttaaattaaattatacaataagaggaatgcatttaatttaaaaaatgtgatatattactaggatatatatatttacttcaaaagtgattctacttttatctttcaaataaaatttattttcctaaacctatttttaaaatatcatccgtataatataaatcaatttttttaatgtaaaattcaaaatattcaaaatccaaacttaaaaactctagtgttgtgtcaatgcaatataacttactccgctcttctggagtgatttcattctccactatatgttcatcagcagctgaagtagcaactagagttatttcactcacacctctgctttcatgttgcggtgtggccgaggcagcagcagctgaagtggcaactggagtttgttcatgactttgactaggaatgtgatttgatgatgatattataatctgaattttgtggtcatctgaaacttcgacattggagttcatgattttctaaagaaatgcccgtgggatgtgtgaggaggaaactagagtggaccaactcaaacatgtaatgtaatgtaacatgagacaggttcacagagaggaaaggattatgaaaggaaactagcatgcatcgcagttatatatatatatatatatatatatatatatatatatatacaaattaaaggttgaaggaaagatatcatacccaaatatcttgttactgaagaacgatggagaaagaaatgcccgtggtatgtgtgaggaggacacttaattgtcttgttgttgctgtacgttgatcagtgtctgagttatgagggagcggtttctgagcaatgttatatgcaaagagagtgaagctttttgagacttaagggggtgtgtgtgtgcctgcagatgtggctgtggacaatatataatttattaggtagtccggaacaaatacaatcaatatcttcactgatttttaaatgacatatagtgttattatttttttataaattataaactttgaatgcatgttatgtagacattggttgagattatgaatacaaagtgattccacatacactatttaattaatttctcgtggctgacaggtgtgcaatgagaaaaaaaataaaattgttgagcccacatgcaaataactgtactgattttttgagtgaggaaaaagcaactgcagtagacacagggaagacaatcttctttacccaaaattgttaccttacatttttgtttttgttgttatcttttttgtattctaatatttcctataccttttgcatttatttttttgacttatttttatccattttcttaggcgaatttgaaatgttgctttagattagttgtaaagctaagcaaattgctttgttagattcttctgaatgtcattctttttcaccttccgagaaagccagaaggggtcctttattcctttgttaaaactactgcttccaagtattccatactataattctggacgattaaaagataacaaaattcctttcgcactaggtgggggtggaatatatggataaaaattaaaaagcctcaatgtcttgttacaaatcatgccataacactaatcattcaaatataattaatatagtttttcttggtctctccctatctctaactaattaatgcgactagcctccatttgatcctgatgtacttcctttattcggattctatagcttttctccacacatatgtgggaaatagacaccaaggtcttatgtggcccaccttgtgttcttacattagccttgacccccattgtacatgtctctgattgctcgaatatagacaatataaatacctttctgtctccacaggaccacagtcttgcgtatataaaaagtacgtacaataatctcaaatttaaacagaaccttggttaattatttcacaaacaaattataagtgtggacactgccaccttctatataggactttaagatatgaaactctttgcgactaggttgctgaactttgggcatacgatagtatctagtattgggaaaaaccccattgaagccagtcataagaaacccacttggaagtgtgatcaaatatcaaaaaggaggctgcagtgaaagccacaaccatagcagcaacggagatcataagtaaccaacggtcagagcagtcagagcagtggcgaatgcataagtaaccaaatatatatacatatatgcgcattggttgggatcatttaatgtcaatgcacaacatgattaatcttttaattaccacttaataactattactagttaattttttaagttaagatattaaaaataaaaagaattgatctagcttgaacaatgcgagctctctttgcatttgaatggttgccctaaaactggagaatataatgctttgaattcaagtagaagatgagcagctaagtgtagaacgttgttaccttcattgtccactgctcctactatatgctctatcttttttttaagtatactaaaaaaaatgcttctttttccatatagggcagccaagtgcagtggttccgtgcattgttgaggtcccttatcatggtctagttcactattatcgtcaagaacccaactaagagcctcatcattttttgattttagtgcatcaaatagcactgcccaagttatcaactctaaaatcttttcatattccaactgtttaacttgagcccatagttttttaagcaattccagacccgctcaagcaccgtcattgctgtggtcctctttcatgtctagcaacaagcatacatatatagttgattggtccaacaaatgtataacatgagcataaagaaacaagttaaattaaagtttggtcttatatgaaacatcctttttttgacaaacacacaattaaataaataaacaccattctcaaccgatcatgaaagcttacttggaatttctgaaggctttcgcaccagcatatccattgctgttaacttctcttttgcctcttcatctgttgcaatggccaaatcagttggatatttttcaaataatttcattgccacatgtgttacatgcacaaattaaatagcgatggtggattgcatatgtacaaggcaaggtaaaactccaactaaattgaaaaaccacgtaggagttcaactagataaaaaataaaaaaaataaaaaggatggttgattttacacttaccaaacatgttgctgctaatgatcataaaaaacagtcgttgaatatccttataagccattttgtgaagcagattctaagaggacaaaatttgcaccattttgttttggccatataaaacagccaagcgaactggaagcatcccatctgagtttggtatcagcctagaacgattgaatctgcaattttaatgataatgtgctcagtctcattaaatttccctcttttgacttctatgtttcacatgcacaaacatgattatctgcagaagaaaattaaatgttgggatggtcttgctttaggaacatttgttgtttgttctagtgtttaccttcactttctagtttcgaaaatgtcagttactttgcacttttaatatctttgattttctaaacgatattgtcaacagggtttctgatttaggtggttctgttgcaactggtgatgaccatgatgtcactaagaggtttgtgctctgattaatactcatgttacttgcaacatgttttctgtgtggtgaattttgtttattttatattaggaaagatgatgataatgacagcctcgaggagcccaagagaaataacaaggtaatatgatatggaatccaactcaccaagactcccaccatcatcataaggcttccaccatcatacctttcaccaccaactcaccttcataattcaagttttcttttctttatttaattgtaccactttctttatttaattctagaattactactataaataggagtatcatcaagcattgtaacacacaacaattcatttgaatacaagaacaacaagttcttctcttttctctcttttctctctagtccttttagttcctgagccatatttggcatcagaacaaggttccagagtcaagggaaagcctgaattcgagccagaggttcactttcgagttttccggcaaatttcaattctgccaaacatcgaaagtcccatctctgatcgtttttttgggaaaactgacatcgccaccgccggaagtccacgcgccaaagtgaggaggtatcgggttcgtaagaaaattcttagtatgctctgtggttgcagtttgtctgatcttccacatcagaaaagaattattcttgttgctggaaataaaatgtggtagtgtgaaaagtgcatgtctagaaagttctggctaaggaaagacttggtatttaagtgtgtccatttgtgacccacctctctttcctgggaacttacctggtgtactattttacagactacgatcactgttccagtttatctctcacggtactatctacggaatccacgcgacgccacgcgccaccgccggaagtgccacgtcacctgccacgtcagccactcatccaatcaaaaactgtcacgtgtcagtcaacgccacgtcagccaatcaggtgctgccacgtgtcctgatcgtgtaagttttcaaaatttgcagaaaagcccctataaatttcagaatttaattttcagtccctacacttcattaaaattaccatttaacccctgcacttcctaaaattaccaatttacccctacaccccataaaattaccattttgacccctactaaaattactattttacccttactctaaaaaaaaaaataccattttaccctcatacctataaatttaccaatttatcctcatactttctaaaacccatataatggcccctagacgcagactagttcacgaaactataattgaagaattgaggcaacaaattgaacagttgcaagcaactgtaaatgctcaacaaatacaactagaggagcaaagagcattccaaagctacgattctgaaaatagtgattccgcatcgaccagcaatcgtcgaacgcaaaggcaagccttccgatcagacgatattagagtgaaaatcccagaatttgaagggaagctacagcccgatgattttgtagactggctacaaaccgtagagcggatattcgagtataaagatatacccgaagacaaaaaggtcaaaattatcgctctcaagttgaaaaagcatgcttccatctggtgggaaaacttaaagaagaagcgagcaagggaaggaaaaagcaaaatccggacatgggaaaaaatgcgaaaggaattgaatcgtaagtttttacccattcattttgtccaagataattttattcaactacaaaatcttcgccaaaagaacatgtctgtagaagaatacactagggagtttgagcaattaatgatgaagtgcgacattcaagagagagaggagcaaaccattgcccgctaccttggaggtttaaatgctgatattgctcaacaagtccaacttcagcaatatgaaaccgtagatgacgctattcgactatccatccgaatcgaaaagcatcagcccagaaggtcttcatatcaaccttcctcctctttcccctacaggaatactgcaaatactcgcagaccacaaacccaacaacctagcacatcaaatagccaacaaccagtccgaaaccctcgtgcgtccaacaaccaacaacccaacacctccaacaacaaccccccaaaatccaatacagaggtcaactcgagagtgaccaaatgtttccgatgccaaggatttggacacattgcttctaattgtccaaaccgtagagtcattaccatcattgacggagaagcccatgaagtttctgaaaaagatgaggaaccaatctttgatgaagaacccatctttgatgaggaacccgtatatgatgaagaaaccactcctgctgatcaaggtgaactactggtggttagacgtagtctgcatacaacggcagttaaagaagagccgtggctaaggcacaacatcttccacacccgctgcactacgcaaggtaaaatttgtgacgttatcattgatagtggaagttgtgaaaacgttatatccacttacatggtggagaagttgaaactgccaacacaagaacatcctcacccctacaaattacagtggcttaataaaggaaatgaggtgaaagtttctagacgatgtcttgtgaatttttccattgggcagaaataccaagatgaaacttggtgtgacgtaatccctatggatgcttgccacctcttactaggaagaccatggcagtatgaccgtcgtgctctattcaacggttataccaacacttactccttcatcaaaaatggagtaagaatcaagttaacacctctatccccaagtgaactaaacaaggggaagaaggaatcaaagcctctcgaggttctcatttccaggaagcaacccaaattgtccacagaagaagctcataacacgagccttatcctcgtgtgtgaagccaacaaggaaacagttcttccgcaggagattaaggaaatactcgctgattttaaggatgttgtacctgatgagattccttatgggttacctctagagcgagagatccagcatgctattgacttcatccctggagctgtcattccaaataaaccggcgtacaggatgagtcccaaagaacacgatgagattcaacgccaggttgaggagttgcttaaaaaaggattgattcgagaaagtgttagtccttgtgcggtaccaatcctcttagtaccgaaaaaggatggtagttggagaatgtgtgttgatagccgagctgtcaacaaagttaccatcaagtatcggtttcctataccgcgacttgatgatttgttcgaccaactgcatggagctaccctgttttccaaaattgatcttcgtagtggctattatcaaattagaattcgtccaggagacgaatggaaaactgcattcaaaagcagagatggtctctacgagtatacagtaatgccttttggtttatccaatgctcccagtactttcatgcgtctgatgaaccaggtacttagaccttttattggtaaattcgtagttgtttactttgacgacattttggtctatagcaaaagaaaggaagatcatttggaacacattcgtcacgtcctacaaacactacgagagcaaaaactctatgtcaatctgaagaagtgcgcctttcttactaatgaagtaaacttcctgggatatgtaatcaccgctgaaggcatacgagtggataccagcaaaatcgaagccatcaacagttggcctattccaaagtctgttcatgatgtaagaagttttcatggcttcgcttctttttacagaagatttatcaagaattttagctccattgcttcccctctgacggattgcatcaagggagataaattccaatggacagaacaggcccagaaaagctttgaaatgctaaagaaacgtcttaccgaagcaccactactagcccttccaaactttgaccaagtgttcgaggtcagctgtgacgcttccaatgcaggaatcggtgctgttttgagccaagaaggtcatcctatagcctttttcagtgagaagctcaccaatggtcggctcaagtattccacctacgacaaggagttttatgctgtagttcgtgccttacaacactggagccactatctgttgaataaagaatttattctttattcagaccatgaagctctcaagcacttgaattcccaacagaagattaatcgaaggcatgctgcctcgagtgaattcttgcagccatacccattcctactgaagcacaaggcaggagttcaaaatgttgtagccgatgctctcagcaggcgacatgcattactctccactctccaagcaaaggtcatcggatttgaggctatcaaggaattataccaagatgatcctgagtttagcaaaatttggaatgtgacagaatcacaacccttccaaaagtactaccagcatgaagggtttctgttcaaagataaaaccctgtgcatccctcaatgctcattacgggaagcaatcatctgggaagcccatgacggaaatctagctggtcactttgggcgagacaaaaccgtaggcttggtaaaagagaaattctattggccaagactagagaaggatgtcaacaagcacattcaaaggtgcaagatgtgtcacatagccaaagccaagagtcagaacacgggactgtatatgcctcttccagttccattagcaccttgggaagatgtcagcatggattttatccttggccttcctagaacacagcggcagaaggactccataatggtggttgtagacagattttctaagatggcccactttgttccgtgtcagaaaaccaatgatgctgttcaagttgcagaattgtacttcaaggaaattgtccgccttcatggtgttccaaaaaccattacttccgaccgagatgttaaatttctgagtcatttctggagaaccctttggaagaagatgggtactaaactacaattcagtagtgctagtcatccccaaacagatgggcaaaccgaggcaatcaacagagtattgggaaatcttcttcgaagtttcattgggaagaatttaaagcagtgggatcttcttcttgcacaggtcgagtttacctacaataattctgccaatcaagctacgggaaaatgtccattcgaagtagtttatggaactcnnnnnnnnnnattctaagaattttcttaagcccaaataattatttcaaatcaagtttattttacattcaacacgtactagatgctcttttaatccccgtggtatactattaaatattcttttttgttgaaatagcacaaccaagtgcagtaggttccatccatttctgctgtccctatgagtcactaattcaggattcttgtcaataatcatcttcacagcctccgcatttcctgattttattgcatcttcacgattgtgttccaatgattcaacttgagtcaatacttctctatatagtagcttccaatgactacggtaccattcattcaattctggaaggttactcgaactttctgcttctatcagcttatgcgccagcatatccactgctgtaacgtccttttcttcatttcttgcaatggccacagttggatgttttttcaacaacgtcattgccgcacctgttatatgcacaaattaaatagtacaaggcaaggtaaataaaaacaccaactaaattgaaaaaccacgtacgagttcatatatatctccttttatatatatatgaaatcaatgagaatttagctaggacctgtttggttttaaaggatgatatcannnnnnnnnnctttgttccgtgtcagaaaaccaatgatgctgttcaagttgcagaattgtacttcaaggaaatcgtccgccttcatggtgttccaaaaaccattacttccgaccgagatgttaaatttctgagtcatttctggagaaccctttggaagaagatgggtactaaactacaattcagtagtgctagtcatccccaaacagatgggcaaaccgaggcaatcaacagagtattgggaaatcttcttcgaagtttcattgggaagaatttaaagcagtgggatcttcttcttgcacaggtcgagtttacctacaataattctgccaatcaagctacgggaaaatgtccattcgaagtagtttatggaactcgtccgctcagtccattggatttagccatctcgcctgacactcaatactacagtgcagaagctgaagaaagagcaaaggaaatcaagaaattacatgagcacgttcgtgatcagatccagaagcagaactctaagtacaaggctcaacgagataagcatcgaaagttacaaactttcaaggaaggagacttagtctggatccaattacgaaaagaacgatttccaaatcagccaaatgtcaaattatctccaagagcggatggcccgtttcgggttgttcaaaagatcaacgataacgcttacaagattgagctacccggttcttacggagtgtcaactacatttaatgttgtcgatctctcaccatacttcaaggaagaagaattcttagactcgaggacgagtcttttccaacctggggagaatgatatggaatccaactcaccaagactcccaccatcatcataaggctcccaccatcatacctttcaccaccaactcacctccataattcaagttttcttttctttatttaattgtaccactttctttatttaattctagaattactactataaataggagtatcatcaagcattgtaacacacaacaattcatttgaatacaagaacaacaagttcttctcttttctctcttttctctctagtccttttagttcctgagccataatatatatatcaattacttctcggtagttagcttaaatttttcttgtgtgattgaaccttctggtgagtaattatctcttgtctatgcagactgtgaagcttttgctggttacaaaagaatttacttcagacattcgggaaattcacaagttgcttcactgacgtgcgaatacaagtacatttaatagtctgtaaaacttactatacaaagaaccaaaactatctggttttcttaaaacttttggtgaaaatgtcgttgaaattgagcaaactattcactatagaatcagcactagcacataatgtggaaattctagctgagagatgcaacattctaaagaaccttgcagcagcttgatgttaaatattatctgaataatgaaatgttttttttttttttctcatgatttgcacagagcctggacattgcagtggcagaggaagggggtatcgatgtcagaagagaagcatgaggaataccctgaatggtccttgtctgatatggaaaaaatgaacattatattgatcccatgcagctagctgattaacttaaatggaaggattgatgaagatgaagaggattatgatgaagaaatgtagatgaacctgttttggtttagaaagttctaattgagaattagagtagaatgtttaggagtagtattgtacaaatccttagtggttaggaagattaggagggacaggacattgaaaactttagtccttacaacctttgttttaggataaaagtggagatatagattgttccagttagaaataggctaagtattgttatttgagaaatcatgcctatggtaggcactgcattcagatccttaaacttacggattttgattttgtttgggttgttagctttgattgtggcgttgtgtatgtaagtctgttattgtatcacatgacgtttcctatcgagtacaatttgagagcaaatctgcggagcaaactcactgatccgactacatgataatgatttgcacttgaaccttttttgttatcttgaatttgttgagaaatcagataaatggaaaagaaataagagggatagaaataaaagtttaatatctatgtataaaatagctttaggattttataaactatcattcaatcataaattattattttaaaaggtaacaaatttattatatatagagttgtgattggatgattatataattttttttatattctcaatgcataactcttttctagaaataatcacaaaataagatgaaaaagatgtattatatagatgaatagaaataacaagaaaaaatgtaaatttttatttgtttaaataaataagagagtagaaaacaaaaatatggtcattgcaaaaatgttcatagaaataaaatatcaaatttaacttgaaaaccctgaaactttttatttcattatttctcaacataaaaatattgttataaaacaataatttgattttttaaaatttaaacataagtaaaagaacactactaaccatttctccctccatttcacgtctcttagtgagaaatatggtttggttaggactcattgattataatttcatttctcattttctaacacattcaatcaagaatattttttattacttatttctcttcattttaattttatacttattataattttgttgtatataataatcctttttaaattgattaagattaagtctcaataaagatgaatttgtaacaaaaaaaactttttatgtgatatgattgctcccttcaccaatccacatggaaggaaggggaaaagctttgacgtgggttatgcagcagtctcaaattaagacgggaacaataagaaaggtaatatttcatgagatagaaaatgtagaataatctcaaatttaaacacaagcttgattgttccacaaacaaataataatacagtgccttaaagttatgccaatgtctataattctgtaataagtttgtcctgtttggacaaacgataatatctagaccacaagtgtttgtcgaaaaagttaaattgaaagagaagaaacaaaagtattgggaaaagcaccattgaagccactgcataagaaacccacttggaagtgtgatcaaatatcaaaaaggaggctgcagtgaaagccacaaccatagcagcaacggagataataagtaaccaacgcccaatagtcaagctgggatgtagtgatttcacaaattcgctttgtgcgaatcttgatgaagtgaaatttgacaaaaatgagagtaaagacgcagaagaagcgaataatacgactgcatttgtcaatatgaagacaggaaaccacgcattgatcttatcacctggaacagtcagagcagccgcaaatgctatggtagcaacaagtgttgacacaagcatgccagattcggctattcctttggctgtttccttaatttcttgggataacttcttgtgttcttcagaaaatacatcaattggtgtcttgcccatgttgtttctcattgttcttagttcacccgccggaacattcgactccacgaactatttacaaatcaagagaatatgtaaatgatggtatccaaatgcataacttaattaatctttcaattatcacttaattaataactagagcaaatttcagcaatacctcctaaaatttagtgtaattacacaaatatattctcaggtataagcttaaaatttagagaaatgttagtgtaatattttcaaacatataaaaaatgttagtgtaattttcaaatttaaaaggagttagtataagaaaataaaaaaaaatggaattacatataagtacacgaaacttgaggagaattatagtaatttgttataataactattagatattaaatttgtaagatatacaatttcaaagttaagatattttaaaaataaatcttacgggtgatatttattgttacaaatgcacgtgtataatttttaattaaacttttctatctatatattggctgtttaactattatgctaaagacaatggataacaaattttaaaaaattgttacaataatcaacaaatactacatacaatgatttctatttttaatttaaacttgttacttttaaagatttaaaatcaggctagctaacataagcctaaaatttgtggaattttaaatttttaaaataatattgctagaactgatcgatcccatgcgagtgaataaagaactgaccttgaaccacgcgagcactctttgcatttgaatggttgctcttaaactggacaattcttcgaattcaactggtggacgacgcgcagccaagtgtagaatgttgttaccttccttgtccagtgctcgtactgttggaagaggattgctattaatatttggagagaggcttttaggctaaaggatttctggaagagtagaaagattttggagaagagagattttattacttgaacttgattttatggcttgatacaaatgagcaaatcctacacctatttatacttggccaacttctcatccaatggctaagatttctccaacacaactttgatccaatggctataatttaacttctacacaattccacctaaatatctatcttctacacacttccatacttatccatatcattctacttttaaagatatttctagaacacatttctagaacatgggccaaatgggcttcacactctagaaaataggctaattgggcatatgattctaagaattttcttaagcccaaataattatttcaaatcaagtttattttacattcaacacgtactagatgctcttttaatccccgtggtatactattaaatattcttttttgttgaaatagcacaaccaagtgcagtaggttccatccatttctgctgtccctatgagtcactaattcaggattcttgtcaataatcatcttcacagcctccgcatttcctgattttattgcatcttcacgattgtgttccaatgattcaacttgagtcaatacttctctatatagtagcttccaatgactacggtaccattcattcaattctggaaggttactcgaactttctgcttctatcagcttatgcgccagcatatccactgctgtaacgtccttttcttcatttcttgcaatggccacagttggatgttttttcaacaacgtcattgccgcacctgttatatgcacaaattaaatagtacaaggcaaggtaaataaaaacaccaactaaattgaaaaaccacgtacgagttcatatatatctccttttatatatatatgaaatcaatgagaatttagctaggacctgtttggttttaaaggatgatatcacagtctttcagaaacctaatagtcataattaattatttcaactgattcaatgggttcgattcagtttgtaaaacttcataatatgtaaaagagaacgtactagattacaaaaaggagaaataaggttgtttaattagttttacacttaccaaacatgtcgaacctaatggtcatcataaacagtcgttcaatatccttgaaattcattttgtcaagcacttcctcagaggacaaaatgtccaccattctgtcgggaccatattcagcagccaagtgaactggaagcatcccatctgagtttggtattagcatgtcttctggcctcatacgcttaaccaactcattcacaatttcaaacatgtttctctttgctgctagatgaagagctgtgtctccacttgaattttgtattagcatctcttctggcctcatacggttaaccaattctttcacaatttcaagactgctttcacttgctgctacatgaagagctgtgtctccactatcatttaacggaatacttaccatatcaggacgtttatcaataatctgtttcattacttcaaagacgattgttatctaagaaccgtcgtagtatatgacattctaagacggttgttacacaagaaccgtcttagcaagcgacattctaagacagttcatagttaacaaccgtcttagaaagcgatatactaagacggttagtagttaacaaccgtcttaaaaagtcattttctaagacggttgtgctaacaaccgtcttcgtttctatgataaatatttaaaaaaaaattaaaaaaaggaaactaagacgattttacgctaagaaaagtattagaaatgagctttttaagacggttgcaacgctacaaccgtcttagaagtcatattctaatacgattgtcatgtaacaaccgtcttagaatgtgactttctaagacggttgtagtgtcgcaaccgtcttagaatgcccatttctaagacggttttttgttgatcaccgacgtagtttcattttttttaatatttagttttttcaattttttttttacgcgtacataataataggcatggtcatatgatcaattttaatggaccatacaaagtatataaaaataaatataatttcattgacaacattaatctcaaagtttcactaacaataatataacgtctataacattttgtgatgctaattacaatggtaaaaaaaaaaaagtctacaaaacaagagaaaaatacaaagtagtctgaaaaaattttgcttccaaatattcttgttctcactttacaagatctccaatgttcttatacataatattagcaaaaggaaaaaaaaaaacagatgaaaaaactagagtgcaaataaatagcagagcgaaagtattcacaatttttatcacacgtgctacacaccttgatcaaaagatgactagaaactctatcatcttcttctcgagtacgaagcccctaaaatttaatagttttcagaataaataaatataattttttacataaaacaaaatgacacacagatatatatatatatatatatatatatatatattatataatatactattatcacatgattagcatcaaattcatagcaacacatggaaaaaataataggataacaattaaaataaatcattattcatttctttgatttctagctagctagggattattttgttaatgtctctagtctgattattttagcttttgatcagtttgaactatcaatccagtttcataattggggctatcaatgcactcaagcagcgctgttcttaaccttttatgcttctccagaaacctcttcaatggcgaagacgctacagcttataatataaacacagctgagtacttataaaaataaatgaactggtagaggaaattagaatttggaccaaaataattcctcaatgcattgttaacagtctcaactaaatacgctatttttgcaggactttgtcattcttaagcattgttaacaacatttaattatatatctatatctcatttaattatatgcatcattgattaaaaggaaacacttaaaacatatacacgagctaagaaacttgacttacaacaatgtaggtgatcatgaagtgtcccatttgaagcataatcaaaaaccaacatccttgtaaatggagtgtcctctctacaatagcccattagttttcctatattctcatgatttaaccttgccaagtctgccacctgaatggcataaataaatattaaaagatttggacaactatttgtgtgcaaattctagcatgctgtaggaataggaaaatttccatttaccactctctaaaaatagagttcaagatatcctgtccaaggtaaagagcacgtgatttaaaaataatgataaaaaaaataaggccagcaacacttgtttttagccccagctacatacaccaatccaaattaccaaaataaggccaaaaaaataaaaaaaaaacccaccaaaacacagataaaaaaaaaatgcttttgtaatgattaaattttttcaactatttcatcttaaatataagaaaaatgtaacttatattaattgaaaaaattagttagcattatttagtgtaaattatatttttagttattgaatttttttatttttcacctatatccattctcaacactggcttgggttttcaaaagaggaatacaacttgaataccagtaaaagccactgcacaataaagtcaagactaagctcatttcatctattccgcatgattcaaattttttgaggtgttgaaaggtaatgtcaatacataccacactgtatagaagaacgctgctttaactcttggccctggaggcaattcccttgaatattagctaaatggtttaataaataatattgctattccaaattaacaatctctgtccacaaaaatgaaattcacttttttatttaagaagaaagagattagccaatctgatgtatttctttttagtaatttttgtcaaattgaataattaaatataaaaaaataacagaagggtttatgaaaaaatactaaaagaagaaaatcatgttatatgaaaacattggtacctttaacattggtgccaagaggaagaaatcacccactacatattcaatttgatcatctacaccataaatcattttaagaataataagaagtttctcataggaagaataagtatttgacaaaaattacaacattatacttatgtggcagaaattttaacccgaaaattgcttgatagtggaatgacatatatatatatatatatatatgtgtgtgtgtgtgtgtgtgtgtgtggcagaataagtatctctatgtctagttgtaactagcagtcaaaattaaatgaacattggcaattactagttactagttactagactatatgaattggaatactatgcataaagataaaataaagtgagaaggatatgaacatatgctaattagctaatattggaacaaaacgaggctgtgtgcataaatgagatgataaaaacaaaccaaaagacatgtttaatgtttctcctttgctatgttatcttaatgttattcaagttgcaaaaagaaagcttaatgggagtgagtttcataatttataaaataaaatgagacgaactcaagtggataatattttgttggttctttaataaaatatataaaaaacattagtagaatacaataagaaggacgttatttgtgtataggtttcgtgcagaaacttcgtaccatccaacattttcgtttgaataaattagaaacaaaacaaataagggtagagatacgagaaagaaacaaattgtttctctatttgaaataaattaaagtaaggaaaaagagaggttttttatgaataaaaaaatataggattttatttatttatgaaattcacactcaacaaattctttcttcttgtggtgagatatgtgaggagagaagagtcccttcaattaaaaaaaatgtgaatataagataaacaatttataaaataaattgaaattctcatttttttttagttaaataaaaattactaaaaaaattctatataatttgtttatgtttcacctttcttctttccaaattctatataaaaattgaaatttatttaagcgaagaaaacttaaagaagtggacaaattttaacaagggagaaaacaatttcaaagtgtcaaaagaagaaggaagggctcctcacaattaagattcaaaagcacagtgctcagggtacaaaaaaaaaacccgtttgtccacttcttttcctcatttcagacagcaaagattattatttctctgtaagggagaaaaggttttccataaactaatgacagttcaacaagacccaaaacgatggaacagtagctctgaaaccaaactaatatttaaaaaagtcttgttatgattaaggaggaaaaggaatggaaggaaatctgagaaaagaaaaccacatacactaaccaattacatgacttacatgtgagaattcttcatagtgtatcactgtctacctctggaccacttcagaggtctactgaaaatacatcaatcataaaaaggaatattgttagcttaatatatccacatggtcgatataaatacaagtcagtggacaggagttgataaaatttagccaagaatcacatcatattgcaggcttgcaatcttacaacacaaggtttaagtagcaaaaatacttgcggtcataataaggttcgtcagaatgatatggattaagagttaataggccgtttcccaaatgtacaagaccttgggcaattagcacctatagaaacaaaaagaatcagtggccatcgaaacacccgaaattggaaaaataaagataactagatgaacacacacaaaacagaaggttggtatccttgtagtaatagcttgaaagattgcaaagcatgccagcaattcgagcattgtttgttccggcaactatttatttatcacattaaataatataaatagaataatattataaatagaataacattaaacttatatttatcacaatgcatttgatgaaaccaaatattatcaatcaagagtttaatcagatttgcatcataccactccaaatattgagaaggcatatgcatagctagtccaggatggatcaccattttgcatagactgcagacaatttataggataagtaaaatggcattacgaaaattgataaaaataaaaataatattaataataagatattttgagaataataatgtcagagtgtgtgtgtaataaatttggggatggtcttccattagtccactaaacatgcactagaggtacttaaccagtaacaattcagtaaaagagtaactgatatattaaaagctgattcaatataagtgggcccaaaaattgggaaatatcattgccaatctacatgttaacaaaagaaaaaataaatcatccattggaattattgaagttagaatgggaaaggagaaagtatggaatagaataaaatgactattcctagtgtcactctcgttaggcatgctaaattataggataaactaccatagtatttactggaacctgggctccattctatcatccttgcctcaacccttgctttgagagcacaccaaacaagatcctgaacaagaattgagataaaagacattaagaaacaaaaccactagacacaaacccgattaatttaaaatctaaactaaaacttcctcttgggaagaagaataactcatctgaaaactgattgtcccgtcacgtccatttaagtttaaattttttatgattgtcaagccatagatagcacatccacacacaacatataggatattttatataggacaatccttagagaacttgatggcaagggtgttaggaacttgatcaatgttttgtccatatatttaactatgtcaagggtacttctaaaactatataagcacatagattatatcagtctcaactaatagaagagtttcacttttcaattgtcatgttatagaaattttacaactgttcatgtctctgatgacgttgaaatattcataaagctagtcataatcttatagggttggaatctttaaaagttcaatgcacacttattcatgcttgtatagggaggtagttctcaagaaatttagagaaagtggaagtattgattccctatgaattaaaagaatcctagaactagaacttgcctttaagattaagttctagtgcccaacagaagccatgaaaattcaatacctaacagcattgtgattaatgaacagcagccacaatctacagcaatgaagcattgaatagattcaaaggaaagatgaaaggtgcagaaataattatttaatacttgtgttttgacaaaagaaacattgaatagattcgtaggaaagatgaaagatgcacatataattatttaatacttctgtttggcaaaaaacatatacacaataaatctcacaagtaactgcaactcctccgcataagtaattcatatgttatccattaaatttttaattataaaattgatagtaaaataaattcattcatatggtttgggcaaacatttccttacatactgtttcagattccattaaagccttatagtcagtgcctatttggtttaaattttttaaaattgattttagaagtgtacacttatattaatattgtcgaccaatatcgcttgaggaagtgccaaattgccaaacatggtgtattctatttattttggaagtgcacagtatcaaattgacaaattaatattctattttatccatttattgggatagcataatcccattggcatgacagaagcttctttttgttttacttctgcccaagggggattgtgtgtgttatatgaagaataagttctgctggatgccaaacacgaactattacagcaatatttgattattgggattcattgcccatttggcttgtgcagaatctaaaacaaaagacccatttttttccaaaagcaatgtattattaagtcatctctttcagatgtcaatgttgttaacaggctcaaaattggaaacaactacaactaatcagtttgacaaatgtaaaatcagccctttgaaaccacataagcctaaaaaaacagttcaaactttaaggaatgataacttgattaaggctaatctaaaatactgggcatcaaaatttagtttaagcctttagcctatcttcatttaatcataatataacaaagaacattactggccacacaaagtatgagagtaaaacaaatatactatgatgctgatgatgatgataataatagtgatacacatctcatgcaccaacctggggaacccaagccctaagattcctatcccacttatatacagttccatcatcatcagtaaattcttcttcaccctcgggtggtgtcgaaggtctctcaaaatcttctcctgccccagtaccaccggcattgccagataaggatccaaattccgatacttccacctgtgcctctgcctcctgaatctccttttgccagctttcaaactcatcaacatcaggagcagacactacataacaggtcactgtctaagctccacaaacaacaacaacaacaaataacaataataatagtggaaaattctatgcgaaagagaagaaaagtcataccagtagttgaagaatcaggtccctgcaggttaatttgagcccacaggtcagaaactgaggacaagggctgccactcactccttccttcagaccacacaaatgtattttgggagaggtatccattcaagaaatgctctgtccatgccaatttccatttaaatatgacaaatagaggtttcgatttcaacataaaacaaatgtgctcaaagtctgaaacagcgctgcctaagtattcacttaattaattggggaacaaacaacaaaaatcaaaatatacaatacttaaatacctaaccctagctccactccacttttgttattcaaaggtacaaaaaaaaaagagtatcaaagaactcactcaccgcacaactcagagaatgcataagggccaatctgttgctgatcctcgccaagaacgtaccatcccacttcagtaaccttttcagctgcgagaaaccaaattattattgaaacgaaatcgaataaggagtaagtcaaattagtggaactaatcgatttttttttctgctgcaaattaaagttgagaaatgaaaaaaaggtgaacagaatatgttcctcttctcaccacgaaccatgtattccaacttaagcctttcaagtggagccacacaagttctgttaataaaaaaattattaattgaagtggtgaaattaaatatacttagtgaccatagcagctatagcaccagcccagagatgtttggtggtgttgacgacattgcatcctcgtaccctaacctttctctgctgaacgacatcgtttgaggttatctccgttggcgccgagggttggatttggaaaagggagtgtcgtgaatcttgaacgaaatgaaacgaacgaaggaattgggtattttggggtcgagaaacaatcctccggtgaaggaaccaaaatcaggaatcggattgaagaaaatgggaggggagtgttcattttggtgctgacagagttcacctggttgcattgccgttctcagacgtcggacgctcacttcaactttcaacacggaggacacgacgtggttatagctagggtgagtgggtgcgcttgccagagacatctacggtgagtgggtgcgcttgctggagacagctagggtgatggacaatgggagagggagaggaccttaagggatgaaagtaagttttagggcacgaaaatgattgggctgaaatttttaaaagcaaaaatggatacaattttcgaagacggtcataggcaaaatgtctttgaatagacaaaaactaagacggttaaactaaaatcgtcgtagttttgaacatacaaagacggttttacaatgaccgactttgaaatattcattttaattacaaaaatgccaccggaccgcaaacaacatcggtttcgcgacaaccgacttcgaatctctgtcgttaaatgtactatttctagtagtgtgtagatatttattatttatgtttgtttaggacaaatgaaagagaaaatacaaacaaatgaattgtttgaaaaaaaattatacatttttttaaattatttccattatttttctaacataagattattattttttattatataatatacttatttgattttcaaatgtaagcaccactaatcgcttctctataaaactaatctcgcctcaaactagttggtttaaatttaaaacaattatttttaaataagcacttatttaataaataaataacgttgatcaaaataagtagaaaactgttttttaagcataaacacaatttagacaaatacattaaaaaactgaaaattatttattttattaaaataaatatttttttcaacaaataaatttaagcatacttatcaaataatatcacttgatttacaagcgggagttggggcaattagtacacgtcagacaattataaagaatgatttgaataattaacttattaatgtgggacttgtatgtgcctaccatgaggtgaacgttctctaaggtggaatataaagaatgttcttatggttttgaatctacttggaatactaataagaggtgaaactaaaattccaaagtacagttaacttggtcgtagctctagatccacattctcacatgcctcggtccctgattggagatatatgaagtttatatttaatatggataagtcttaggaaaaacagaatagtcggccggggctcaatctcaaagtttggaataactataatttcttattaaaatgccgatctaaatggttcttaataacagtggttttgagttgtgacatatatttgctcccttcaccaaccacagggaaagaaggggcaaagctttgacgtaggatatacagttttcgaaaaggcattatagtctcaaattaagtcggaaacactatgataggaaatgcacgatagtcttaaattcaaagactaacttaattgtttcacaaacaaatatataacacagtgtggacactgccacactgtctataaatcaagatacagaaaatgacgagaaagttttagaatgtgccagtatctataattatgtaataagttactagagttcggatggaagataaaatctagacaagtgtttgtcgaaaaagttaaattgaaagagaagaaacagaagtattgggaaaacccccattgaagccactgcataagaaacccacttggaagtgtgatcaaatatcagaaatgagactgcagtaaaagctgtagaatataaaaaatttatgcagtgagagcttgtggagaaaacaacttttaacaaatactttattcaatttatttctctttctttctatctttgcttttctatctatttttctttctcttctctatcttttttttctctctcatattgttaaacattacaatgatttatttataagttataatatgcccatcaaaattttaaaagacttaaatcttattaatagacataacccacaatcaaaaccccattataattatttataattataaactacaatcaaaattcgttataatcattcatagtcataaaatataattattgttgactcttgacctttcattttcgtaaaacaaaattgttaatgaaacccattaaacttttaagtttattcaacaaaagctacgaccatatccgcaacggagacaaacagtatcgcaggctgcagtaaactcgctttctacaaatcttgatgaagtgaaatttgacaaaaatgagagtatagacgcagaagaaatcaataatgcgactgcatttgtcaatacgcttattggttgggatcaattaatgtcaatgcataacttgattaatcttttaattacacttaatgactattacaagttaattttttaagttatgatattaaaaataaaaggaattgacctagcttgaaccatgcgagctctctttgcatttgaatggttgctctaaaactggacaatgctttgaattcaagtggcagatgagcagctaagtgtagaacgttgttaccttcattgtccactgctcctactatttgctctatcttttaagtatactaaaaaaatgtttatttttcgatatagggcagccaagcgcagtaggtttcgtcgattgttggggtcccttgtcatggtcactagtttactattatcgtcaagaatccaaccaagagcctcatcatttcgatatatagttgattggtccaacaaatatataacatgaacataaagaaataagttaaattaaagtttggtcttatatgaaacatattcttttgacacacacatcattaaataaataaataaaacaccattcgcaaccgatcatgaaagcttacttagaatttctgaaggctttcgccccagcatatgcaatgctgttaacttctctttttgcctcttcatctattgcaatggccaaatcaattggatatttttcaaataatttcattgccatatctgttacatgcacaaattaaatagcgatggtagattgcatatgtacaaggcaagataaaattgaaaagccacgtacgagttcaactagataaaaaaaaaaggatgtttggttttacacttaccaaacatgttgctgctaatggtcataaaaaaagtcgttgaatatccttataaaccattttgtgaagaggacaaaatttgcaccattttgttgtggccatataaaacagccaagcaaactggaagcatcccatctgagtttggtattgttggataccaagtaatcatacaaccatcgagatacaagaaggagagaaaagagaaagagaaaataacacaagtttatcctgattcatccaatgtggactacatccaactattacctatatttccttacacactataaagcactcagattaaaagaaaatatataggcttaaaaatcctaaacattgtaactattcatgcactcaagcctaaattacatataataaaacaaagcttagtgtgagtcatacccaacaagtatcagcctagaatgatttgatatgcaattctactcataatgtgctcaatctcattaaatttccctattttgctttctatttctcatatgcacaaacatgattacggcttcatcaccgaaaggagaaaattgttttttgttattacctaggacttttttaaataattagattaaaaaagttatttataatttttttaaaaaattatgatttaaaaaaaacataaaaaagcataaaaaagtaaaaaaaaattgaagaaataaaactaaaaaaaatgtaaagaaagaaaaatcacgattttaaaatagtaaaaaaatttatgactttgaagttataataaaaaaattaaaaaaaaagttacgaaaatcataaaaaaaattttacaactttaaagtcgtatgttaaaaaaaattatactgaaatcgtaaatttatttacgacttcagttaaaaaaaattaaaataaatataagttgtaacctttgttacgatttacggcatacatctttgtgctaaaaaatttaaaatctacccccaaatgataatagcagtaaaaaaaaattaccctctaaaacccatgatttgactgtaaatgacatctacggaagaaaattaaatgttgggatggtcttggttttggaacatgtgttgttgttctagtgtttaccttcactttctagtttctaaaatgtctgagttacttgcatccttgcctttgcagaaaacagtgagtgcagacttttaatgtctttgattttctaaaagatattgtcagaagggtttcttatttaggtggttctgttgcaactggtgatgatcatcctgtcactaagaggtttgtgctctgattaatactcgtgttactaggaacatgttttctgtgtggtgaattttgtttatttattttatattaggaaagatgatgataatgacagccacgaggatcccaagagaaataacaaggtaatatatcaattcaggctgagttggcttaaaatttttcttttgtgactaaaccttctgctgagtaattatctcttgtcaatgcagactgtgaaccttttgctggttacaaaagaatttacttcagtcattcgggaaattcacaagttgcttcactgacttgcgaatacaagtacatttaatagtctgtaaaccttactatacaaagaaccaaaactatctggttttcttaaaacttttggtgaaaactgttgttgtaattgagcaaactgttcactatagaatcagaactaacatattatgtggaaattctagctgagagatgcaacattctaaagaacctcgcaaaagcttgatgttaaatattatctgaataatgatttttttttcttcatgatttgcacagagcctggcattgcagtggcagaggaagggggtatcaatgtcagaagagaagcatgaggaataccctgaatggtcattgtctgatatggaaaaaatgaacattgatcccatgcaactagctaattaacttaaatggaaggattgatgaagatgaagaggattatgatgaagaaatgtagatgaacctattttggtttagaaagttctaattgagaattagagtagaatttttaggagtagtattagacaaatccttagtggttaggaagattaggagggataggacattggaaactttagtccttacaacctttgttttaggataaaagtggagatatagattgttccatttagaaatagccacggtattgttatttgagaaattttaatctcatataggtcttgcctatggtaggcactacattcagatccttaaacttacggattttgattttgtttgggttgttagctttgattgtggcgttgtgtatgcaagtatgttattgtatcgcacgacgtttcctctcgagtacaatttgagagcaaatcggcggagcaaactgactgatctgacgacatgatttgcacttgaaccttctttgttatcttgaatttgatgagaaatcagataaatggaaaagaaataagagagataaaaataaaattttaatgtctatgtactaacactaacaatataaaacaattttaaaattttacaaattatcatccaatcataaattatcattttaaaaattaacaaatttattatatatatactataagttgtgattggatgattatgtaaatctttttagattctcaatacataacacttatctagaaataaatacaaaataagatgaaaaatatgtattctttagatgaataaaaataaaaagaaaaaatatataaatttttatttgtttgaataaataagagagtagaaaacaaaaatatggttattgcaaaaatgttcatacaaataaaaaataaaatttaatttgaaaacctgaactttttaattatttcgttatttctcaacacaaaaaaatattttgtgataaaacaattatttgatttttaaaaatttaaacataagtaaaagaacctaaccatttctccttccatttcacgtcacttggtgagaaatatggtttggttgggactcattaattataatttcatttctcattttctaacacattcaatcaagaatattttttattactttatttctcttcattttaattttatatttattataattttgttgtatatagtaattcttgtcaagattgagtaagattaagtctcagtgaaagatgaatgtgtaataataaaagctttttctgtgttatgatttgctcccttcaccaaccacatggaaggaaggggaaaagctatgaggtgggttatgcagtatagtctcaaattaaggcgggaacaataagaaaggtaattaatatttcatgagatagaaaatgtagaataatctcaaatttcaacaatagcttgatgattccacaaacaaataataatacagtgtcttaaagttatgccaatgtctgcaactctgtaataagttagtccagtttggacaaacgataatatctagaccacaagtgtttgttgaaaaagctaaattgaaagagaagaaacagaagtattgggaaaacccccattgaagccactacataagaaacccacttggaagtgtgatcaaatatcaaaaaggaggctgcagtgaaagcgacaaccaaagcagcaacggcgataataagtaacgcacgcccaaaagtcaagctgggatgtagtgatttcacaaattcgctttctgcgaatcttgatgaagtgaaatttgacaagaatgagagtaaagacgcaaaagaagtgaataatgcgactgcatttgtcaatatgaagacaataaaccacgcattggtcttatcacctggaacagtgttgcggactcggcaagtgcaccgatcgtacaagtaatataatgaaaaagtaagggatttgtcgttcccaacgaggattgtttggcccatttaaattataaacttaatcgataagttggacgataattgaattgaatggattgtggttgtgtgtagacaatggattaaaactaaacgtaaacattaactaatttcaacaattgattaaggaaataatgatatgtatggaaatgtagctagggcaacccacactcaatgcgcctctctatgaaataatattgactactatattctattatccaagctattcaactgatgcgttcttcttatattgactaagctttgatgtctcttccacttagttctttaacccaccatccaaccctaatctcttagtgatcttaagcaagttaagcattaagcaacgcataaataaattgagttgcaagcatccatccctatgtcgaggtgatgttagcaagttactacacttaggtctgaaaccaaagccccaatatgtctattgtgaacttaagctctaagcttttacctaggttagctaagtctaagcaaaagaagaagatggaagtacaagtgcagtaaaatagcttgtaataaatgaacaatagcattcaatacatcccaaggagatttacattaagtgttttggccctaactacattatatgctcagccaaacctcataatgggtggttgagctacaataataaccaaacctagctggagcatagaagaagaagaagaagaagaagtccccacttggtcttcaaccttcaagccctagccaagccttcaagcctttaagaacccttgttatgtgtttctcagtgccccccaaaaacgtccattgaatgctggtggttggggtatttaaagccctccgcatgaaatctcttatttgcccttaatgtggctgctgtcgacctgtggcgtccctggcgccagactggcgctcttggcgccagcttacagagaatgtggcgcccttggcgcgggaacggcgctcttagcgcgggactccagtgaatgcagcgctaaaagcgcggaattggcgctccaggtgccaacttgcagaggttgtggcgctcctggcgccagactggcgctcttggcgccatattacagaggtgacgacgcttcaggcgcggttatggcgcctttggcgccagattccagaacccatggcgctcttggcgccactcctggcgctgacggcgccagatgcttcttcaggcttggctctttttcctctgatttgaccctgttccttggtattttggtcgatttcctgtcaatacatcgagataagtcaatatacgcataaagaggtcatagatgaatgctcaatgcttgaatcttggtctaaaagcttggaaaatccttatatgctgggcgcatatcaaccaattcccagatttagatcttgctgtcctcagcaatcaacaaagttcaaattggaagcatggatcaattctcaagaatcaatattgaaaagaacaatctcttagcttaaaatgctacaaatgaggagatccaaccaaaacttcacacaaagttttcacatccatcaacaatgaagtctaacttgaataccctcacagatgcaaaattcactcacactcaagtgtttaaagtattcactcagtgcatcactgttctaggactaccataagcttgatcttattctcaagttctacaaaaagaacacaatatatgcaaagttgatccaaaggtcttaactgggttgtaacttggcttggtttaaaggcaggagtatctggaaagtgactagaaagcatttaagattgaacttgctacatttttggctttctcttttcctcttttcaatcattcttttagaatttccactttctcttcttccttcttttctttctcacttgctaattccttccttttacacttatcaattggcttaattgaatgccattcttgtttttcattctcttttactttcatcaattcaccttgatacttattattatnnnnnnnnnnnnnnnnnnnnnnnnnnnnnnnnnnnnnnnnnnnnnnnnnnnnnnnnnnnnnnnnnnnnnnnnnnnnnnnnngatcaaacaaaagaaggcttcaggctcaaagggggttagcaagggatcataatttttaaggaaggctatttggctcaagctgaaaagaacaaaatgcctttatcacatcaacatatgcatacattaaagagaaaccgatcaagttctagcatcctatcacaatgaagcatcactcacaagaatttaactgtttaggctcaaacctttcaggctatggtacaagctagactcctgatgatatcagatcaaacaatgcattccatttcgaaatgaattcattcatacaagcattcatacgcttcagttcaagttcagacaacatgacttcatgattcacctcaccaatgctttccaaaatcaaattaacaatcagctgatttagcaatttctaatctgggaggcatgccttaagcaaaattgtctaatatgtacatctatgcttaggttgaaattagacgcaaaattcacaaaaagaaaattgttatccaaaaagtatctgtccaaaaagcttctgcctactgttcagttttcgatcaaaaagacacaaaaagacgcatgattcacaaaacgacacttgtttcctcgattaacgtgcccctattcccagatttaatccctttgttgtccccaacaaggtaacgtataaaacacacaaagacgacacgttattagaggaaacaacccatgcataactgaaaatcaagcaggagctaaccaaagagctcgcgtataaaacaatgtcaaagcatggcagaatgtcatatgtacgggcacacacctactgtgccaaaatgtgcaaatgtctactgtaaaagtaaagtgcggaaatgtaaatgactgaaaaataaagctgaaagagagatagagagtgaggaggatcagtgggtctggtcctcatccatggtgtcaggatcgtctgctgtgggtgatggctgagcagctggtgaagggagagcgaaggcaagtggtggaggctgtgatggtgatctctgagggtcaacagcaaagtgctggcacagggcgtgagcatcctggattggtcatccagctgggtctgcatctgctgagccaggagagtgtgctgatctagctgctgctgcatcttctgggtagtggtggtcatctgagcaatctgctgctgcatcctcacataagtgatggaatcctaaaaaatggactccctgtcaggggcatgggaggaagcagcaggggtttcctgaactggtggtgatggtggagctggagtagcgggctgctgaggtggtggctgatcaggctgctggtgcacatcaggaacctctggcataggaacccctaaacctgcatgaggtccataccgcgggctcctggcagcgatctcctccggtgtcatatcagccgcacgaagaagctgctcctggagagtgcgccgaactgaatccaagtaaatccggtgagtcaaaggagctcgcggctgcacatccaacggctcctcctctgggatctcaagatcggcgtgcatgcagagatgggagatgagtgaagaatgagccaggtgagagtgggtgcggccatccataatcatatgtaggatgcgctcagataaaacctctgagatatcaagattgatatcttgctgaaggacatacagaaggcaggctcgctcaacattcacgtctgtcaggttggaggacggaatgatggtggagttaatgaacaggtgccagaagtcagactcagcatgcagctcactgcgtttaagcttctcaggcacataagaaaaaccggtcttcatcctccaagcagagaagcgcccagtgatgcctctgcggagctcgtccgccagctgaggcatgtcatctctataggtggcgcgtcccgtgcctggatatggctgcatcttatcaaaccgcttcatgaagccgcagcggcgaagctcatcgacagaggtcctcaaaaagtcttcaataaactctctgtcgaagggaacaacaattcccctaacccagctgcgcctctcctttgtcacagtaggcgcatctatgttggcgcagaattccttcaatatagtgctggagctgggctcagcgaagctgaccagcttctgccactgtcggcgctgaatgacctcaaggatgggggagtccgcaggcaagtcctccgagtcgatgacccgctctggaatgattttcttctgagagtaccacttgtcgaaacgctcttgatgcgttttcgacaagaaacggctgtcatcatagtcggcggtgcgggggcgtttgctggtagccccgggagtgaccttttgcttgcccttatctacctgttttccctgaaactcagaaaatgccaatataccaaatgatttccattagggcgttaaaaacagatacatttggataaccacaattcccagatttatgttcaactatatcagtagcaatcatgttcaaagtagcacatatagttgcatggaatcgccattcatatattgataacaagcatgcaagtgtggaagagcataacacctcaggacaatcatcaaaacaagagaaccatgaacaaataacagatcctaggcttgaggcaattcaaccaagaattccaaacagcttttcaaagtaaagagtttatgctcatgttcagtaagtgacagcatagcctaggagtctaatcatctgattatacactcatgttaaccagtcaggcatacaattccccaattcccagatttatttgcaaccatatcattaacaattgtattctaatcctcacaatggttgtaacaagtcagaacatgcaagggaatagagctttatgtgaagggaaagtaatgacatgaaaggttgtggatggaattcccagatttaagtgaaacatgagggttcacaaaagatttaattattctaagaaatttataaccaagcccacacaatttaagtatccaaccaaacaagcacacagatttacaacaaaacgatcatacaagcacattgatacagtgatgcacaatcaaaagttatggatatgaggcttgtgtgaaacagaaatgcaacaaattcccagatttggatcactcaacacccattacaaggtgcttcaaaggatgaactcaattcagtggtcatatgcacaatgtgcaaagcagagttcagcaatggggactaataatgcagtttatcatctcaggtcctagggtttcattcatgtattcagaacactaaccaataatgaaataaacataaaagccctaaaaaccctagaacattataattatgtcccaacatggtaccccaatgcatgctatcccatgatattaagcaaccaagcatgtatttactatcaaacagataaagaatagacccatagataccatcaaaacacaagtaaagccccaagtacacccatggtgtggacatccacgctagggcatgggctgggaaaacagaacagagaagctgccacaatggggtggaaattctccacccaaagtaaccctaactcacagagaagccccatgaaggaaggagaacgtaccttgtcacgacccatagtcagtaatgagagacgattgagaaagagagagagggaaagagagagaactcgaaaactgaaggtgcagcgagagagagagagtacgagcagttgaggaaggagaagggggcgagaatgaatgtggaagtgagaagaatcaatggagattgagaagaaaagaggtgttctggtcttggaaggtgcagagcgaatgagggagaagagaaatgcgtgggaattcgaacaattttaaaacatacacagcgccctaagtgcggcgctcttggcgccacacccgcgcgacaagcgcgagaaggcagaagacacggcgctgatagcgccattctggcgctcaaagcgtgatgttccagtggtaacggcgctcacagcgccaaagtcgcgcccggggcgccacatactgcgcgaggggcgtggagggacagaaagcatggcgccctcagcgccatatcggcgctcttggcgccataaattcaattccaacccagctggcgcttggggcgccagaactcgcgctaagagcgtggatgatcagagatcgtggcgctcttggcgcctcggtggcgctttcagcgccacttcccagaagcttggcgcgtttggcgccgtggtggcgcctttagcgcgggtttacagattgattggcgctctgagcgccaatgcggcgctcttggcgccatgctttttcacaacccacacataaccaaaatagtgccctaaaataaaaatgaacttatttccacatgcattcatgaaaacaaaacaaaaagtaaaagccaaaggattgactattcttaacctatgaagtctacctatgccttgctgagctaatgattgaaactaacctaagaaacaatttcctacacaatattgagttgcctctcaacaagcgcttgtttaacgtcacgagcctgacggttaatcctcacggattaggggagctcaaagggattgcacttgcatccctatcaattggaccaccatggtatggcttcagccgccatccattgaccttgaagggttggttagagtccagaggagaaatttctatggtaccataaggaaaaacccttactaccacaaatggaccagaccatctggacttgagtttacctggaaacaaccgcaaacgcgagttgtacaataatacctgttgacctggaacaaactttttgtggtggatgtgcttgtcatgccatttcttggtcttctccttgtagagcttggcattctcatatgcagcaagtcggaattcatcaagttcattcagctgcaacaacctcttctcagctgcctttgaaagctcaaaattgaggaacttggtggcccacatagccttatgctccaattctaccggaagatgacaagatttcccatacaccaattgatatggtgacataccaattggtgtcttaaaagctgtccggtaagcccatagagcatcatctaacttctttgaccaatctttccgtgagttcccaactgttttctccaaaattctcttcaattctctgttggagacctcaacttggccactggtttgtgggtgataaggtgtggccaccttatgggttaccccatacttactgagcaaactttcaatattcttgttgcaaaaatgtgtgcccccatcactgattatggcccttggaactccaaaacgggtgaatatgttcttccgcaagaaattggcaaccactctggcgtcatttgtaggtaaggctgcagcctccacccactttgacacataatcaaccgccaccaggatgtattggttggaatatgacttgggaaagggtcccatgaagtcaatcccccaaacatcaaacaactccacttccagaatgttgttgagaggcatctcatctttacgggatatgttacccgttctttgacatctatcacagccctctacaaattctttagcgtccttgaagatggtgggccaatagtagccgctttgcaacaccttgtgggctgttcgattgcctccaaaatggcctccgtagctggaagaatggcaatgccataggatctttggaacatcaaattcagccacacaccttcttagaatgccatcagcacattgaaagtagaggaatgggctgtcccaatgatatcttcttgcatcatgtaggaacttcttcttctgctgccatgtcaagtcctccggaagtacaccaacagccttataattggccatatcagcaaaccatggtgtagcagcgatggccaacatttgttcatcagggaaagactcattaatcaccagttctggcccatcttgcaaatttgtggcttgaatccttgacagatgatctgcaactttgttctcaacccctgctttatctctgatctcaagatcaaactcttggaacaatagcatccaacgcaacagccttggcttagcatcctgctttgtcaacaagtacttaagagcagcatggtcagtgaaaacaataactttggacccaatcaagtaaggcctaaacttatccaatgcatatactactgctaacatttccttttcagttgtggcatagttaatctgtgcctcattcaaaactttgctagcatagtatatgacatgtaaaagcttatccttacgttgtccaaggacagcccctatagcataagcgcttgcatcgcacattagctcaaatggtaagttccaatcaagggctgttagaactggtgcagtagtgagcttttcttttaacacattaaaagcacttagacaagactcatcaaagacaaaatcagcttctttagtcaatagttggctaagaggtctagcaatcttggaaaaatctttaatgaacctcctatagaagccagcatggcctaagaagctacgcacactattgacatttgtgggaggtggcaatttttcaattaacatgagcttggcctcatctacctcaatgcctttggaggagattttgtggcccaaaacaaagccatcacgtaccatgaaatggcacttctcccaatttaaaaccaggtttgtttcttggcatctttgcaaaacttttgacaaattagataaacaagcatcaaagcaagagccaaacacagaaaaatcatccatgaacacctctaaacatttttcaaccatatcagagaaaatggatagcatacacctttgaaaagtggcgggcgcattgcacaacccgaatggcatccgtcggtaggcaaatactccgaatgggcaggtgaatgctgtcttctcttgatcttccggtgccacgggaatttgattatagccggaatatccattaagaaagcaatagaacgcatggccggctagtcgctccaacatttgatcaatgaagggaagtggaaaatgatcttttctggtggcatcattgagtcttctataatcaacacacatacgccaaccagtgatggttcttgtggggatgaggtcattgttctcattttgaaccaccgtcataccgcccttctttggaactgtttgcaccgggctcacccaagcagtgtctgatatgggatagatcatcccagcatcaagaagcttcaccacttccttccggacaacctccttcatcatgggattcaatcttctctgaggttgtctaacgggcttcacatcatcttccatcagaattttgtgggtacaaaatgaaggattgatacccttcaaatctgaaatagtccatccaatggcagatttatgtgcctttaacactttgatgagctttgcttcttcatcttcagacaagcctttgctaatgatcacagggtatgtgtcattttcccccaaaaacacatacttgagggctgcaggaagttctttcaactctagcttaggtgctccaacctcaatgtctgtggcctttttctccaacacctccatggctacctcctctgattcttcaataactgccacttcctggatttgcagcagctcgtctaattcttgatcaacagagacatgggactgaactagatcatctagcacatccaaccggaagcaatcatctttatccattgggaccttcatagcctctagtacattgaatgtgatggactcatcaaacatcctcagctccaacttcccttcagccacatctataatagctctagccgtagccaagaatggcctacctagaagaacaggtatttctccttcttccatgtctagaacaatgaaatcagctgggaagataaacttgtccaccttgaccaagatgtcttctatgaaaccactcggtcttctcaatgatcggtcagctagttgcaaagatacccgagtgggtttcaactcagaaatgcccaaggatttgcatatagacaggggcatcaagttgatgcttgcaccaagatcacacaaagctttgcccacattaacattacctatggcaataggtatgttaaaactccccggatctctgagctttggtggaactttgctctgaataatagcactacactcctcagttagaaccacagtgtcgcactcttggagcttatgcttcttagacagcaattccttcataaactttgcatagtttggcatgttggccaaagcttcagcaaatgggatgttgacttgcagcttcttaaacatttcaagaaacttggcatattgcttcttttgattttgctgcttcgtccttaagggataaggaggcttctcaaacctggaaaaatccagaggttgcttaggctcagctgctactttctcctttcccttatctttttctggttctttggagctgctgcaatcttgtggtattgcagaattttcaatgtctgcagaattctgagatgctgcagaattctctgcacttgcatcagcttgtggtactcctttttcttctcttggtgccacccttatgttttccttgggggcaataacaatgccactcctagtagtgatggccttagtgtgttccctaggattaacaactgtatcactagggaattggcccggtggtctctcagctagttgccttgatatctggccaatttgagtctccaaattcctgatggatgcaccttgattcttcaaatgagaccttgtctcattcataaaagcatcagtgttctggatgtggtcatttgtagtcttggccagctgcaacatagctttttcaagctcagatggctccttgggagggatgggtggtggttgcaaataatggttggatttataatccagaccacccccatgtggtcttcttggatagttacttccactcccagaagcttggccataatttctctgataaccttgtggtggcctttgatcataccatactccattgacttgaatcggatcagcccccaccaaggtcggacaaacattggactcatggtccccttggcaatattcacacacaactgcattagctttaatagatgaagcttgagctctagcaatctcaagtttatctatcttggcattaaggatagccagttgttgtgacaacagtttctgctcagctaacatagcatcgctactccccaaatgaatgacttccctcttggccttggctgcaatactttcattttcatttctggccaatgagtcgatcaaatcaaaggtctgagcagctgtcttcgaccttatggaacctccagctgcaccattcactactagtctggactcaggtagcattccattgaagaaaatgcgtaccttcttgcccaccgtcatgtcatactgagggcaccgccggatgagttcttggaatcgattccaagctgcacacaaggtttctccttcttgttgagtgaaattggtaatttcattcaccaatctgttgtacttctccattgagaaatattgtgcgaagaacttggacatcaattcctcccaggtggtaatactgttagaagcttgtcgatctagccacctgagggcttttcccttcaaggcaaaaggaaatagccgaagtcgaatagcatcatctgatacaccttgatgccggatggtatcacaaattcgaagaaatctatccgcaaagtcatgaggatcttcgttgtcctcaccaccaaactgactcctttccaccaatccaatcaaagaagggtggatgtcaaagttgttggcttgaataggtggcctgactatgctggaggtaggcctggtgaataatggagctagaatgtcctccattaattcatcctctggccttggcggatcattatctctacctgccatgtctagttccccttcaaatgtttcttcttcaagaggttgagaactagacccttctgcttctcttcttaaccttgttaacctccgattcctcctcgcggttttctcgatttcaggatcaaactggagttggtcagggctaacggtacctcgcatatactctagaagcaagtcagtaacaaaagaaatccaatcttaaagataaaaatttataatgaatttggctaaaacaatccccggcaacggcgccaaaaacttgttgcggactcggcaagtgcaccgatcgtacaagtaatataatgaaaaagtaagggatttgtcgttcccaacgaggattgtttggcccatttaaattataaacttaatcgataagttggacgataattgaattgaatggattgtggttgtgtgtagacaatggattaaaactaaacgtaaacattaactaatttcaacaattgattaaggaaataatgatatgtatggaaatgtagctaaggcaacccacactcaatgcgcctctctatgaaataatattgactactatattctattatccaagctattcaactgatgcgttcttcttatattgactaagctttgatgtctcttccacttagttctttaacccaccatccaaccctaatctcttagtgatcttaagcaagttaagcattaagcaacgcataaataaatttagttgcaagcatccatccctatgtcgaggtgatgttagcaagttactacacttaggtctgaaaccaaagccccaatatgtctattgtgaacttaagctctaagcttttacctaggttagctaagtctaagcaaaagaagaagatggaagtacaagtgcagtaaaatagcttgtaataaatgaacaatagcattcaatacatcccaaggagatttacattaagtgctttggccctaactacattaaatgctcagccaaacctcataatgggtggttgagctacaataataaccaaacctagctggagcatagaagaagaagaagaagaagaagtccccacttggtcttcaaccttcaagccctagccaagccttcaagcctttaagaacccttgttatgtgtttctcagtgccccccaaaaacgtccattgaatgctggtggttggggtatttaaagccctccgcatgaaatctctgatttgcccttaatgtggctgctgtcgacctgtggcgcccctggcgccagcttacagagaatgtggcgcccttggcgcgggaacggcgctcttagactccagtgaatgcagcgctaaaagcgcggaattggcgctccaggcgccaacttgcagaggttgtggcgctcctggcgccagactggcgctcttggcgccatattacagaggtgacgacgcttcaggagcggttatggcgcctttggcgccagattccagaacccatggcgctcttggcgccactcctggcgctgacggcgccagatgcttcttcaagcttggctctttttcctctgatttggccctgttccttggtattttggtcgatttcctgtcaatacatcgagataagtcaatatacgcataaagaggtcatagatgaatgctcaatgcttgaatcttggtctaaaagcttggaaaatccttatatgctgggcgcatatcaaacagtcagtgcagctgcaaatgctacggtagcaacaagtgttgacacaagcatgccagattcggctattcctttggctgtttccttaatttcttcagataacttcttgtgttccttataaaatacattaattggtctcatgcccgcgttgtttctcattgttcttagttcatcaggaacattccgcttcactaactatttacaaatcaaagagtctagttaacataagcctaaaattagtggaattttaaatttttaaataagattgctaaaactgatcgatcccatgcgagtgaataaagaatggttgaataaagaaaactaagcaaattatttgaccttgaaccattcgagctctctttgcatttgaatgcttgctcttaaactggacaattcttcgaattcaccttgtggaagacgcgcaaccaagtgtagaatgttgttacctccatagtccactgctcgtcctagaagctctgttaattccggtggtataatatcaaatattatttgttgtcgaaatagcaccaccaagtgcagtaggttccatccatttctgcggtccctataagtcactaatctaggattattgtcaagaagcatctccacagcctcaacatctcctgattttattgcatattcacgtttctgttccaatgtttcaacttgagtcaatacttctccaaatagccgatcacaaacgtctgattccttggcaagcattaatttgtgttattagaataactcaacaaacatcaaataccattattagactggatatagataattaaggactaattcttaattttttatataaaacaaaaatatatatataactttctaaaatcaaaatcaaaatggaaatgatgtcaaataagatctaaattttagcttagaacacaaaaaaaattaaaaagccattttcaacttgtgaaaggttacctgacattcctctaggcttttcccccagcatcttcactgctgtaacgtcctcttcatttcttgcaatggccagagtagttggatgtttttcaaataatcgcaatgccgaatctgttatatgcacaaattaaatagtataaggcaaggtaaattaaaactccaactaaattgaaaaaccacgtacgagttcatatatatctccttttatatatatgaaatcaatgagaatttagctaggacctctttggttttaaaggatgatatcacagtctttcataaacctaatattcataattaattatttcaactgattctcattaaatttgttattgaattatggtcaagtgtatcgaatgacattggaattgtaaacattatatatatatatatatatatatatatatatatagcttatggtatctgatcggttcaatgggttcgattcagtttgtaaaacttcataatatgtaaaagagaactagattacaaaaaggagaaataaggttgtttaattagttttacacttaccaaacatgtcgaacctaatggtcatcataaacagtcgttcaatatccttgaaatccattttgtcaagcactttctgagaggacaaaatgtccaccattctgttggaacgatataaagcagccaagtgaactggaagcatcatatctgagtttggtattagcatctcttctggcctcatacgcataaccaactcattcacaatttcaagactgtttatctttactgctagatgaagagctgtgtctccacttgagtttggtattaccatgtcttctggcctcataagcttagccaacttcctcaccattccaaccatgtacatctttactgctagatgaagagctgcgtctccacttgagtttggtattagcatgtcttctggcctcatacagttaaccaactcattcacaatttcacccctgccttcgcttactgctagatgaagagctgtgtctccccttgagtttggtattagcaagtcttctgccctcatacggttaaccaactctttcacaatttcaagacggcctctctttactgccagatgaagagctgtgtctccatatgagtttggtattagcatgtcttctggcctcatacagttaactcattcacaatatcatcgccggattcaattgctgctacatgaagagctgtgtctccccttgagttttgtattagcatgtcttctggcctcatacgcttaaccaactctttcacaatttcaagaccgccgtaacgtgctgctagatgaagagctgtgtctccacttgagttttgtattagcatgtcttctggcctcatacgcttaaccaactctttcacaatttcaagatggtctctctttactgctagatgaagagttgtctctccatctgagtttggtattagcatgttttctggcctcataagcttaaccaactctttcacaatttcaaggttgtcgtaataacgtactgctacatgaagagttgtgtctccattatcatctaacggaaagtgtaccatatcaggacatttatcaataattgattttgattccagccactcatcccgcaatatatgtcttatcagatcttcttttaaagaacctgcaatcctttcaaacttcacattataatatgtcctttatataataatcataacttttactatttagttgcaaagaagacccttcaatttctcgtttaccctaaatctgtaaaaattctgttggaaacttgtctcatattttgaaaattcctaataatttcatcatttgtaaattgaaatctagctgagaaattcgagattatgtagtagtcgaagggatccaatcatcaatcacctttaattaagtttgaaatttgaatttcaatttgtgtttgaaaattaactctatgatgataagtaaaattggttttgagagaagtaatttattttttcttttcttcagttgacaaaagcaaattgatcttaatatgtgacttatttacactaactttaaaagtgattctactttttttttttttaatctttcgaataaaagaataattttctaaacccattgttgaaatgtaaaataaacaaactcttaagacatgatctctgaaatgcaccctcttgtgaatgaaatagtttaaagtataacttactcagctcttctggagtcatttgattcactcctctactttcatgttttggtgtcggtgagtttgttgaagtggcaattggagtttgctcatgactttgattaggagtatgatccggtggtatctgaattatgtggtcatctgcaacttcggtattggagttcatgatttaattctagggaaaatgaagtgatttggatacctctctaaaattccctgtgttacttctttctttccagcctgagaagcttaacatattacatatggtggtaaaacaagagcccttaattattttccaacttgcacttaaaattactatttccgatgtgacattttgtggattacagccatgttaattgaatctgttcaacatttcaaccccacagttttcaaaagctttttaagttgaatgatttctaaatttatataatattaattcatttttaaagtgaataaatatattcattaaatttgttaacagaaaaaaaaaattcattaaattttgtgcatcagcgagattcgctatcatgacactgttaattaacttactcttaatttaattaatattatctttcttcattgtacaatgaaatgatatgatatgattggggtagttatatatttattatatatttccgttgacgcatttaattttatgattatttatccaacacaatttttataaagtttaggaagacaggctacaatgggagagggattactctcaatttaatatattttttttcgttggacaatgatataatatctaaatatttttagtgttagatcttgaatttaagatctgatttatattaaattttttaataaatgatttgaacaaatttctaatatggaaaataagttttaggagaagaacctttaatataatgttaaaaaaagaattttttttgtctctcccctaatatctcaaaatgagatctatcattaaagaaaaaaatgaaagagatattgaaagattttcaatcttatgtgacactatggagtctaccaaaaagtagtctaagatcctaatttgagatctttcactaaagatgagcaatgatattgagcttaagatctcgtcttcactaaattttccaataaatgaggtgaacataacttcacaatgaagaatgaatttttgtagaagaatctttaagatctacacaatgttaaaaaaataatttttctcaccctctctcactattatttcaaaatgagatttaccattaaaaaaaatgaaagagatctttaatcttacttgacactatatagtctactaagaagtggtttaagatcccaatttgggatctaccactaaagatgtaagcatctttagtgctgaatcttaagcagagattttgaattcaagatctgatcttcactagatcttctaataaaagagatgaacaaatctctaagcatgaaaaatgagttcttgtagaagaactctgaagatttgcataatattaaaaaaagaataattttttatcccctctttttccataagatttcaaaatgagatctattaagaaaaaaatgaagagatcttcataagtatttaatcatatgtgatactataggtccaccaaaaagcaacctaagagcatatttagtagtagatcccaaattgtgacctttagatcactttttggtagactttatagtgtcaaataggattaaatatctcttctatttttttctttagtaataaatttcattttgagatattagagaaagtgaaaaaaaatattcttttttgaatattgtacatattttaaggattcttctaaataagatattatttatgttaaaaatctgtttacttcctttattaaaaaatctagtaaagatcagattttgaactcaaaattcttagtaaagatatttcaattaaaaatctactattaaaatgcttattattaacgaaagctttctgcaatagctgtggttatatatttatctaccttccgttgtcgcatttaattcttggattatatctaagtatggtctttttatacatgttatagtcaactatgccaacaatcattgaattacaagatgtattttattatcggaaaatgtatgaattttattaaacccactacaacaaccattgaattcaaagcaagactagaaaaaaaaaatacttatttaatatttcggtgaaatttattcagccagtcatattaatagttatttttgacatattaatccttttatgttacgtaatataaattattttattaataataaaaaaataaaaattaacaaataaatagatttttcatattttttcttttaataatttaaattttcttatttaaaaaataaatttatcaataatttatatatctaaaagataaaaataattatttatcctaatatattttataatgtttagaaagatatggactatgatggaagaggataaacagtctgtcatccttagaaagagtatcttatgaccatcaaattattttgtttaaaattcaatgaccgtaaatttttcttctttaattaatttttttctttttttttgtccttctctttcccgtactacccttttcccctttcttcttctcttctttcccattcttcctctcttcgtcttagtggcaacggtggtgccatgacggtcggtgatagtggggatgttaatgtgtcgttgtctggtcgttgtacggagtaaactagagagaactcgagagggtctttcgccgtttttcttgcggtgttctgcaacaagatttcaaccggagaaaaagcatggaagacgaaacagtcacaaagctttatataactattgcctcacttaaacccaaattggattcaactgaccagatttttgtctcccaaagttttgagctttttgatatttgttgtgcacgtgttgattttttctcatggatgccaagttacgagtttgtttcttgcataaacgttgtttctataccattttactctcaattttgagtccaatttgggagaatagaagacctaagattttggttttgaaaatcagatgaccttttttatgacgatttgtgattatatttgaaattgtagtttcaaggaaattattgtaccattgatctgtaatatttgtaatctggccttgttttctatgttcagatatgtgatgggtggtggtggctctgtcgccgcatttgtggatgtggaatagggaaaaaggaggaaaggaaggggttgtcgaaaattgctttttgcgtaggtgtcgttgtcgaatacaagaaaaatggaagaaaatgaataaatcggcaatggtgatgaataagccagagggataaatccggaagtcaagaagaaaaggaaaaaattataaagaaaaaaactcatccatgggattaaaattaataaatctaatgatggaaattcactttcccattgtggaagacctattatattctcccacactagtctttatccaaaatatttcaaatcttgctttgaattagttgttgacatttgacaccttgtttcatactaaattgtacaagatgtaactatatatataggatttaggatttaaatcatggataataagaaccctaaatcctaaattataaatcacatggaaaaaaaaaagactttgacatggtgtatgtgtagtttacggaaaagataatatggattaattatagtatgtttgaattttggctttaaaattatcatgaaatggtgagataagtcaaatttaattttatctaaaactagataaatggctcatgactccacctgtagtaattttacaatttataaccttttataatataataattttttatgtatttaattattatattttaattaataaaaaatattattattaatatgttagtatttaagttaacattttttttattatcattataataaattataatggtgaaaattcatccatgggattaaaatttgataaatctaatggtggaaattcactttatcattagtgggagacctattacactctcccacgctagtctatgtcagattagggattaaattgtgcattatgaaatatttaagactaaaaataatattcaacgaaagtacagtatcccacatgcaagaggtaactatatatataagatttaggatttaggatttaagtcaaggctaataagaaccgtaaatcctaaattataaaccacatggaaagaaaaagactttgacatgatgtatgtgcagtttatggaaaagataatatggattaattatagtgtgtttggattttggctttaaaattatgaatgaacataagatgagtcaaagttgattttatctaaaactagttaaatggttcatggctttcaccacagtaattttgcaatttataatttttttataatattataactttttaagataacatttttttattattatcattataataaatatttatgacaatttaataaaaccatgataataaaaaaattaccataattattacaaaaacatataagtgttaattaaattataatccatattatctcatgcatcaattattttttgactataaaaatatccctaattaaataagagagaaatcatattaacatatatatttagaagagagagaaacattaattataatagtatttttgaaaacatattattttagaacaaatttattattatcaacttaattaattatttttttaatcttgataaattatataattgagtcttataaatagaaatagaggtaatataatatagtagacagtagattttgcatgtttagttattttagcataattaattttaattgaaaaaattatatatgatggagttgaagtaggaataacttctacttctaccaaaataaattctagttatattttgtttaatttactttcacataaatactctcatatgcatatgtttgtttttatttatttatttaaaaacataattaaaattcttgctatatttatagattctagttgttatattttttttattgaatgtattttatctaatttatccttgtactcataaccttaatagtgtgctaaatcatttaaaaaaaaagaaggaaatattatatttcagtataattattagtacatttgggtttaattatatatatatatatatatatatatatatatatatatcaaaataactaattgtaatagaaaatcagtgaatatagacattcaaattcattttgatcattacaccatcaaaatcaatttaattcaaacctatattgcaaatcaattctaaccataattatgtaaaatctcattgaaatcaatgcctttcttctgactgaaccccttgacaactaatcttgctttatacctgggttgtgaagtaacttcatcttgtttcaccctgtacacccacttgttcttcaaagatctctttcccttaggcagttttactagatcaaaaatgtgattctcatgcaatgaatgcatcttatcttgcatggcttcaatccacttactcttttgctcatcttccataacttcttcaaagcattctggttctcctgaaacagtcatcaacacatactcacttgcaggatatgtggtggaaggtgctcgacccctagtagatctcctaggaggagcatcagtagtagtctttggtagaggtaaatgctcatcaacaatatcatggttctccatgggctgtggagcatatgtgccatctaaatcacctataccatgtccttcctcaacttgtggtggatcgcatgatataggaggtggatccaagtcaatcaaatcatgattattctctggcattgaaatctctgatttctctatatcctttatagtctgaccttccataaacacaatatatctacttctcattgaatgatcatttatgaaagtgacataataaagagcaccaccaagtgtttttgtcttcataggacgacaaacatcagagtatactaaatcaagtgtagctggcattcttgaaggaggggaactcttgaatgtaactctattttgctttcctgctaagcaatgagaacacttcttcaatggtgctttcttcaatcctggaagttgctccttattagctaaaatagtcaagcctttctcactaatgtgactaagccatttgggccacaactccattgtatcttcattttctacaacaataatttttcctatagagatcgttgcatgtgtaatatacaatgatgaacacttctttcctttagccacaatcattgaacctttagtgagcttccattgaccatcattgaatgtgatatgcacctagcataagtactttccaagcatatttagatcataaaatgcatgagaatgaatgataaaagcttataaattgcataaacgttgacacatttgctttgatagtgttttaatcaatttggagttgtcaacaggtgaaaagagccaaagaaataacagagaaagcaaaatcaggcatgcggcgcgatccgcgccgttcaccgtgccatcagcgccagagttttcaagtgacgccaaccgcgttatattccgcgcgattcgcgcggatacctctctggaaaatggattctctctggaatccagcgcgacccgcgccattgtcagtgctatccgcgccaatgctgctctggaacttggaaattcactggaagttggcgccaaccgcgccacagtccaagtgagaagttcagttgcagcccgcgcccttcgcgccagttccgcgccattcgcgccgtgtcccacgcgttcagcgccgtactctgcgcgttcagcgccgtactctgcgcgatcagcgccacacttaaaacctgctgttttcaagtgctgtcagggtaaatttgggatttccctaccccaagtataaaagcagtaactcacctctgaagaagggacttttggacgaaaaatcaccaaaggaaaggaaagaaagaaagcttggaagcttagctagggtttggggattgtgaggtcaagtgggttcttctccttcttctcctccttctccttgcttgtgtatcagctgggcatgcttctttttgctgtaccaaagccagccatgaataggtttggctagttctattttgtagctagggccaagcacttgatgtaaatcccatttgggttgtattgaatgctattattcatttattgaaagctattttactacactttgcttgaatgttcatatctctttcttagacttgatcaatctattaagggttttagagttagggttcacaataggaatattggggctttagtcttggaactaagtgtggtagcttgctttatattacctaggaatgggaatgtatgtgggtagcttattcattatgttgcttaatgcttaaccctaggaaggtgactaaggaattagaacttttaagtgggttaaagggttgtgtcactgaggaatcggtaaacaactgaacttagatacacatatgtgctaaatagcctaactaatcgaatataagtatgcaatacgaaccatttgggaggaacatcgagtgtgagtgccttggctacgcttcgtttacattgtgaaagcttattttcttgtttataacttagtttatgtttacaaacatcgccttactttacttgttcaaacaaacaatcaacacatttacaaaatatttgttcatccaacttttagatttaagttataatcgaatcggtgcactaatcctcgtgggaacgatatctgacttatcattttattacttgaacgaacggtgcacttgccgagttcgcaacaagtttttggcgccgttgccggggattagtttcgccaattttatcataactttatatctttaagattggaattcttttgttacttacctgcttcttgagtttatgcgaggtacagttgatcctggaaaccttcagtttgatcctgaattagaaagaactgcaaggaggaacaggagacttgccagagaaagaagagaagcaaaagcatctagttcacagcctgtggaggaactagatatggcggaaagagagaatgctccgcctaggccagaggatgaattaatggaggacattctagctccattgttcaccaggcctacatctagcatcgtcaggccacctattcaagccaacaactttgacatccacccttctctgattggtttggtggaaaggagtcagtttggtggtgaggacaacgaagatcctcatgaatttgcggatagatttcttcgaatttgtgacaccatccggcatcaaggtgtatcagatgatgccattcgacttcggctattcccttttgccttgaaaggaaaagccctcaggtggttagaccgacaagcttctaacagtattaccacctgggaggaattgatgtccaagttcttcgcgcaatatttctcaatggataagtacaatcggttggtgaatgaaattaccaacttcactcaacaagaaggagagacgttatgtgcagcttggaatagattccaagaactgatccagcggtgccctcagtatgatatgacagtgggcaagaatgtgcgcattttcttcaatggaatgctacctgagtaccgattagtggttaatggtgcagttggaggttctataagatcgaagaccgctgctcagacttttgatttgattgactcattggctagaaatgagaatgagagtattacagctaaagccaagagggaagtcgttcatttggggagtagcgatgctatgttggccgaacagaagctattgtctcaacaactggctatccttaatgccaagatggataagcttgagatagctaaagctcaagcttcttccattaaagccaatacagttgtaatgtgaatactgtcagggggaccatgaatcaaatgaatgtcctactttgataggagttgatccgattcaggtcaatggtgtgtggtatgaccaaaggccccctaacaactatcagagaaaccaaggccatgcttctagtagccatccgggaaacaactttcaaaggagggttcaaggaagtggtttggattacaagtccaaccattacttgcaacctcctcccattcctcctaaggagccttctgagttggagaaagccatgttacaattggcaaggactacaaatgaccacattcaagccaccgatgcgttcatgaatgagacgcgagcccaccacaagaatcaagacgcttccatccggaacttggaagttcaaattggccaactttcaagacaaattgcagagaggcctcaaggccaatttccaagtgataccgtggttaacccacgggaacatgcaaaagccatcaccacacgaaggggcactgttatcacccctcaagaaaagccaaaggcagctcccaaagaggtagaagaggaaccccccacagttaatgaagaagcagtggtagaaatacctcctaacaagccggaagagaagaatggagcctctacaagcacaaagaagcctatggatttctctcgctttgagaaagtgccatatcctgcaaagctcaaacaacaagcccaaagacaacaatacgctaagtttttagacatgtttaagaagttgcaaattaatattccttttgccgaagctttagctaacatgcctaactatgctaaattcatgaaagagttgttgtctaggaaacataagttgcaggaatgcgagacggtgatgctcatggaggaatgtagtgcaatcattgagaggaagatgcctccaaagctcagagatccgggaagctttaacattcctattgcaataggcaacgtcaatgttggccgagccttatatgatcttggagcgagcattaatttgatgccattaaccatgtgaaaatccttgggcatctcagagcttaagctcacaatggtatctcttcaactggccgatcgttctttgagaagaccaagtggagttatagaggatgttcttgtcaaagtagacaaattcatcttcccagctgacttcattgtgttggatatggcagaagaaagtgaaatacccttgcttttgggtaggccattcctagcaacagcccgtgcattgatatatgtggagcaagggaagcttgagctcagaatgaatgatgaatccataatctttaatgttttcaatgccatgaagaattcatcagataataatgattgtttcagtatagttgtgattgaagaagtggttcacttagagaagtctccggagcaagaatttgaagaaatcatggaggctcaagatgtgaatctcattgaggaagtgaatgcagtggctatggaggtattagagaagaaagagactaacatagttctcggcgcaccaaagttggaattgaatgagttgccggaagcccttaagtatgtatttttgggtgacgaagcaacttatccggtgatcatcaacaaagggctgtcagaagatgaagaagctaagctagtaaaggtgctcaaggagcacaaatctgccattgggtggtctatctcaaatttaaaaggcatcaatccctcattctgcacccacaaaatcctcatggaggatgatgtgaaacctgtgaggcaaccacagagaaggctcaacccaatgatgaaagaagtggtccggaaggaggtagtgaagctcttggatgcagggatgatctattccatctcagacacagcctgggtgagcccggtgcaaaccgttccgaagaaaggtggggtgaccgtggttcagaatgacaataatgatctaatacccaccagaaccatcactgggtggcggatgtgtgtggactacagaagattgaatgatgccaccaggaaggatcacttcccattgcctttcattgaccagatgttggaaagattggccggtcatgactattattgcttcttggatggttattccggctacaatcagattcccgtggcacctgaggaccaagagaagaccgcattcacctgtcccttcggagtgttcgcctacagaagaatgcctttcggcttgtgcaatgcgccggcaacatttcaaaggtgtatgctttccatcttttctgatatggttgaaaaatttcttgaggtgtttatggatgattttttagtttttggctcttgttttgatacatgcttatctaatttgtctaaagttttaaaaagatgccaagaaactaatcttgttttgaattgggagaagtgccattttatggtacgagatggcattgtattgagccataaaatctcctcaaaagggattgaagtggataaggccaaactaatgttgattgaaaaactgcctcctctcataaatgttaacagtgtgtgtagctttctaggccatgccggcttttataggaggtttattaaagatttttccaaaattgcaaaacctcttagccaactgttaaccaaagaatctgattttgtctttgatgaggcttgcctcaatgcatttactgtgttgaaggaaaagctcacaaccgcgcctgtcttgacggcgcctgactggaatttgccctttgagttaatgtgtgacgcaagcgcttatgctattggggctgttcttggtcaacgtaaggataaactgttgcatgttatatattatgctagcaaagttttgaatgaggcacaacttaattatgccacaactgaaaaggagatgctagcagtagtatatgcattggacaagtttagaccttatttgattggatctaaggttattgttttcactgatcatgctgctcttaagtatctattgactaagcaggatgccaagccatgcctattgtgttggatgcttttgtttcaggagtttgacttagagaacaaagacaaagctggggtggaaaacaaagtagctgaccatctgtccagaattcaagacaaacagctacaagatgggcccgagctagcaatcaatgagtcttttccagatgagcagatgatggccattaccaatgccccttggtttgcagatatggcaaattataaggctgggggtgtggttccagatgatttcacatggcaacagaagaagaaattcttccatgatgctcggagataccaatgggacaatcccttcttgtactttcaatgtgctgatggaatgattagaaggtgcatcgctgaatttgaggttccaaaaattctgtggcattgccatgcttcaagctatggtggacacttcgggggtaacagaaccgctcacaaggtcttacagagtggttattattggcccacaatcttcaaggatgccaaagaatttgtagaacaatgtgacagatgccaaaggacgggtaatatatcccggaaggatgagatgccactcaacaacatcctagaggttgagttatttgatgtttggggaattgatttcatgggacccttccctaaatcatactccaaccaatacattttagtggctgtggattatgtctcaaagtgggtggaagcagtggcattgcccactaatgatgcaaaggttgtggcaagcttcttgaggaagaacattttcacccgcttcggagttcctagagctataatcagtgatggtggcactcatttttgtaacaagcaaattgaaagcttgcttaccaagtatggggtcacccataaggtagctactccatatcatccgcaaaccagtggtcaagtggagatttccaacagagagctaaaaaggattctggaaaagaccgttgggagttccaggaaggattggtccaagaaattggacgatgcattatgggcttacagaaccgccttcaaaaccctgattggtatgtctccatttcagttggtgtacggtaagtcatgccatctcccagttgaattagaacacaaggccatgtgggccaccaaattccttaactttgaactctcaaaagctggtgaaaagcgtttattgcaactaaatgaactcgatgagtttagacttgtagcttatgagagtgcaaagctttacaaggaaagaaccaaaaggtggcatgacaaaaagattagaccaaaggaatttgaacctggacagcacgttttattgtataattctagattgagattgtttccagggaaacttaaatcccgatggtctggtccttttgtcattaggaaagtgtttccttatggaacagtggaaatctgtccacttgatgctgagagaccttttaaggtcaatggatggagtttgaaactatttcatggtggccaagttgatagggatgttgtttctatccctttaagcaaccttgattcctaaaagatgttgcgtcaggctcgtgacgttaaacaagcgcttattgagaggcaactcaatcactttttgtgttattaggttgtttagttgttgatttataggtagtttacttaaaaataggtgttttcattcagttctagtttaaatcagcagtttactcatgttttgatatgtggcgcggatcacgccaagtctggcgctaccagcgccagctgggtttcatggagagctgatggcgctgccagcgccaaagtccacgctgtcagcgccgcaagtgtcccccaagtcaagttttctctggaatgtcgcgcggtcagcgtgagtgatggcgcgactagcgccacctgggtttgcaattcctcctctgcgcgatcagcgcctagtttggctcgatcagcgccaacactattttcaaaataccattccctctggaagttggcgcgggccgcaccaactgtggcgccatacgcgccatattcattagtgtcgcgcggtcagcgtggatgttggcgcggttcgcgcggcaagtttcgaacaacttttatttttgaatttcaaaagcctctggtgccgttttcattccctacccttccacacctctcctttctctccccattgcaatttctctcaactgcttcacttccattaaccccaagcttcattcccttataaggcacctagctttcacttcatcttcttctttcccccttgcgtattcgagtcttcatccagcaagctcagagttccttttatttttgttcaatctgctttcagaatcttatggctggtgataaggtgcgttttcttactattctggcttgaataagggtttaggggggtggttatggcttgcattttgggtgctgtggaaaacccactttctgcaacttggttagggcacaaacccagtccgcgcggatcgcgtgagagttggcgcgagacgcgttggctgggtgttttctgtttacattgataaattgtgtaggcatcctaggaatacttgtgtagttgcacttttggcccttacattctatttctggggttttaggtttataattgttgattaacgctttgaattgaaaccctaggctaaatgagtgaatggggaagggaattgcatgctgttagagggttcaatgattattgttttggttaatgactggtttgacatggtctggaatggattgctatgatttcttgtacctaattgcctatgtcttccacattctgagctaggctaggactttgaacctcagtctacctctttatgattaattgtacatgtgattctagaattgcaattcaaccatgatgtgtacagtcccaatttcttgggtcaattttgctttcacactgtatgtattgtctaatggcttttaccatgagttgctcatgttatgatgctctctgcttcattttgctttgaaatcatgcatgttacaattattagaatagggatgtgcgttgtgttaaatctgggaatcctactttagacagacatatgatatgttgttggatctgtgtgaagcatacattccattgatattggtgaatataatttattcctgattcctttttgcatattgctcttgccacatccaatgtcttgtgtccaatttgaattccactgtctgtcaatgtacttgaaccacagctgctattttaatgctaattgcccctgatatagtcttgaataaatctgggaattgcatgtatccagtgcctaggccatgaattgtttgataaagttgttgaatgttttggtgcattggatctggtttattggatttcagggcaaacaggtggaccagggaaagaaaaagaaaggctctacctccgctactggtaaacgcccccgcatctcagggtatgatgaagaccgcttcagatcacaggaggcccaagactgctttgataagtggtacctcccgaaaaagattatccctgagaagcgcatcagttgggtatccttccctgaagactcgccgatccgacaattgatcatccgcaggcagcggcagacactagtgacatttgctgagccaagctccagttcaattctcaaggaattcttagccaatgtagatagagacacagtggatgatcagagagtcagctgggtctggggtgtgagagtcccctttgattactacgccattgaagacttcctggagacttcccatgtgccgaatgatcaatgtcagtttgcggtcctatataactgcatgcagcctattccagggacagggaagagtgtctatagagacgacatgcctcagttggctgatgaactgaggcatggtatcactggattatacacctcctggaagaccaagacaggtactgcatgggtccccgagaagctgaggaggcaggatctgataggggatgctgagttttggcatcaatttgttaactacactgtccttctgtcgactaatctgaccaacgtgaatgtcgagcgggccaccctattgtttacactgttgagggacatgaacctcaacatttccaggaccctttctgacagaattctccatatgatctgggatggcaacagtcgctctctgctggcacattcttccctcatttcacacctctgcaggcgtgccggagtcgtcattccgggtaatgagcccaaggacgtccctgttgctaccctgatgactctgaagacttacatggactctcggaagaatgcggtgaaggagcaacttttgagagctaccgccatggctccagaggatagagatgccaggagtcctcgcgaggaggctcctgaccatgatgagctccccattcctgagcagtcagctcactctccacagcctcagacagctccttctccccctcgtcaggaaaaacttcctctactggtcaggcatcgcatcgggagcacatttatgaggactctcagagctatctacagctgctggagaagcaggacagtcagcaagtcctgttagagactcagatgcgcatgctggaagccatatgccgccgcctcgccattgatccttctgagtaccagctgcagcctccagcgcttgcatttgcctacccatcaccaccagcacctgcagcagacccttcagcctcaccaccagcccctgctgatgatcccatggcggaagagtgatcttgctgcatgacataattttcttttgtgttcttatttatgctttcattctgttttacgttcagactttttaccgttttgatgttgaactgtgtttctgtggatgtgtttgaacttgttttgttttgaactttggtccgattttgggtaattagcagacggatgttcctacttgtctttgagtcctcaactaacgcatatttattttgctttttcaagacctgtggttcgttatttgctggggacagctaatgataaatctgggaattggggtacgcgttaattgaggaaatgagtgaatcatattttgagaacaaaggatgtctaagattctttttgggaaattctttttggggtcagaaattctttttgtggataattaagttaatgtctaattcctaacttaacttgtaggagtacatattagacaattttgataaagcatgacccagatttagaaatgccaaatcagtaaaaacttgattgaaaatagagacacttgtgagaagaacatttgagaattacatcgcatgaagcatgattggaattagggattgttgcatgactgaagttttgatagaatagaaatgatgtttgatttgaaatcgatgaatctagcttgatacgataaccggtgagaattgtgcctatatagataatttttttagagagttctcactgtggtaacactctagaacttggtttgtttctcaatgatgcatgcataattgatgtgatgaaggcattttgttcttaagctcgagccaaatagccttcctttaaaataatcctttgctagcccctttgagcttaagacctgattgttcattcacctgataaagatttaaaccattgtcattatcttaccttaattgagattggaatgtgaatggttagaaaagaaaacgaattcaagtgaaattttgttgaacatcaaaggaaattaagaaaaagggtcttcatgacaaaagaaaaagaaaaaggagaaaagacaaatgaaggaaaaacaaagaacaaatgaaaatgatgaaaaattgtggtggaatgaaaatttagaagtgaagcttgaatgcatgaaaatttttgtgctattccgatctcaatgttatttagtcactttccaaattttccacccttaagccaagccaagttacaaccttgaaagtccttttgattgagcatgcatgtgttaaatttctgtatggaaatggagaatatgatcaagcttatggtagtgttatcatttttgagattgagagatttgttggttataccctagacacttgagtgctgagtgattttatatcttggtaagggtattcaagctagactttgttgtgatggatttgaaaaaaaaaacattgttgaagttcaggataaaaattcggttgtgtgaacaattttgaattccatgattgttagtttgatgctatgattgaatgttccttccatgcttctttgttcaagatctttgttattgctgaggacagcaatgtataaatctgggaattgtttgatatgcacctagcataagtactttccaagcatatttagatcataaaatgcatgagaatgaatgataaaagcttataaattgcataaacgttgacacatttgctttgatagtgttttaatcaatttggagttgtcaacaggtgaaaagagccaaagaaataacagagaaagcaaaatcaggcatgcggcgcgatccgcgccgttcaccgtgccatcagcgccagagttttcaaatgacgccaaccgcgtcatattccgcgcgattcgcgcggatacctctctggaaaatggattctctctggaatccagcgcgacccgcgccattgtcagtgctatccgcgccaatgctgctctggaacttggaaattcactggaagttggcgccaaccgcgccacagtccaagtgagaagttcagttgcagcccgcgcctttcgcgccagttccgcgccattcgcgccgtgtcccacgcgttcagcgccgtactctgcgcgatcagcgccgtgtcccatgcgttcagcgccgtacttgatcaatctattaagggttttagagttagggttcacaataggaatatttgggctttagtcttggaactaagtgtggtagcttgctttatattatctaggaatgggaatgtatgtgggtagcttattcattatgttgcttaatgcttaaccctaggaaggtgactaaagaattagaacttttaagtgggttaaagggttgtgtcactgaggaatctgtaaacaactgaacttagatacacatatgtgctaaatagcctaactaatcgaatataagtatgcaatacgaaccatttgggaggaacatcgagtgtgagtgccttggctacgcttcgtttacattgtgaaaacttattttcttgtttataacttagtttatgtttacaaacatcgccttactttacttgttcaaacaatcaacacgtttacaaaatatttgttcatccaacttttagatttaagttataatcgaatcggaacactaatcctcgtgggaacgatatctgacttatcattttattacttgaacgaacggtgcacttgtcgagttcgcaacagaatgtgttacaaaattcctcatcatcaagttttcttgttgaaatcaaattcaaacgaatatcaggaatatgtttaacatcatgcaagactaaccttgtgccattgctagtctccaagcacacatctccaactccaatcacattggccaagccatcattacccatcttgacaaatccaaaatcaccagatttgttagatgtaaagaaatccttgcgagatgtagcatgaatgcttgctccactatctatcacccagttggtctcatgacataaaagattaattgcttcacaatcataaacaaggaggaaatctaaagtggtagtaacaactcgatcatctttaccaccttcgtcattcttatcatctttcaacttcccttgtttattatctttcttcatttttcgacaatacttctttatatgtcctcttaaaccacaatagtgacactcaacattgacaaacttgttagacttgcttcttcctttatctctattcttcggaccttgacttttacttctctcccttttttcagtaactaagacttctgactgagaagacgaaacttgtgtctttcttcctttatattttttttattgaatgcattttatctaatttatccttgtactcataaccataatagtgtgataaatcattttaaaaaaaggaaatattatatttcagtttaattattggtacatttgggtttaattttatatatatatatatatatatatatatatatatatgaaaataactaattgtaatagaaaataagtgtatatagacattcaaattcattttgatcattacaccatcaaaatcaatttaattcaaacctatagtgcaaatcaattctaaccataattatgtaaaatcattttggtgcaaatcgacattgattagttttccatatccttcaatcatcttcttgccttaacttgaaccatctacctatagtgctctaaatttcttacaaatctccaatttctccgcgctaccatgaagttgttggacagcaccgacaaacaagtgtcaattacaaaacattggcaaaccgcaaacctatacaaaagcagaaaaagaactgaacaaaaacaattttcttgaatgaatcaacagcttaatattacaagatctcaaattaaatatccattcaagagcttattttgaaacttttatacattatgatgcccgagtaaatccataaaattaagcttttcacaaccattaaatccattcacaaatcatggctacatctttgaaaattggattacctgttttttcaattgtatgttcctgtttgctcttctattttctccgtatagactatgaatgttacagtagaacatgagtagcaatatagagaaaaataaatgcaaactaactaattggtaggataaaacaaaacaagagagatcaaatttaaggtattgtgtttgtttgaggaagatattcgcacacgaggttgaaaccagtattagaaaaaccatcttcaaattggacaattcaactactgaactgctcaagtaacatgtctgaatgtctcatcagtaggctactggatcgatttgcaattgattagtagactatcttttagtttctctctgatcacaaactcttttttagcttagcaaaacttgaaactaattcttttaaactaattttggtttagtttggttcacaggaacaatttggtgcaatctctctgttttcaattcaaagcccaaagcccaagtatatgcacatgtgtgaattttccatgcctatctttaatttgctgacataaggggattagagcttatcattagcaaaaaagggtttatcgtccgaggaattgaagtttagctaaataagagaaattggatcacataattaagacgaccaagagattatcttagggtggaatcaagggaatttcaacacctagccatttttattgattgatttttctagtacattcaattgtactcttgtttctttcaatcaaataaaaaaagtccaaaaattcctacctagctcagtaagcaagtgctacaaacctttgaaactagagtaaaggtacccagggacataaaatgctaggttgtgaggaagtgaatcggttcttacctgacagttccatgtaatcgataatttgattgattgtatatttgataaaccaaattttttattgatacaataatttctcattattttatcaattgtacaaccagtacacttttcgtattctaaccaaactacaacaatatactggtagaaggtgactcagttgatctttaagtcactttacctgaagtccatactccacattgcccacattaggattagtgttagaaaacattacagttcagagtaaagctttcaatttaatttccatataactaaacgtgatggaaataaagttagtagaaccgtagaaatatagatgacacaatttgtttgatgttaattaatgtaaatgtattttcttttgatattcaataaatatgcatgttgtcatcgttaaaaaataaaaagataagctattttttagtttctaaatttttttaatttatctttttagtctttgaattttttatttatatttttcatctcttattaaattggatgatgcattcctgtgtttatcactttattcgatctaaattcctctatggatattaatgaaaaaagaggtccttgactgcttgggcaagtcctcgcgagggaacgttatttgttgaagtacgcatttcatttttgtttgcttggaactatagtaacagatccgtagagatagtctcactattgatttttaaggcagcatggcacttcgatcaccaaaggttcattccattgatagagtcatcacaccctcaaatacactctttttatcccactctctttcattgctccatctcatcttattttttaacttcgtcctcattgatcctcactcaacctctttgccaatgaataaaataaaggggcaagttacttgaaaggcatagggatagactgtttttggttcttaaacatataaataataaaataaaataaaaacttattaagtgtcataacctgaattttagttttagacattttagtaatgattgtgtaatcttattgaattgattattggcaggctaggatttaagaaaattatgcaagctgatgaggatgtagggaagattgcaatggctgtgcctcttctagtttgtaagtagtctttctctttcatgcatattctagggtgtggtcttcttctcttgaaaaatgattttttattttattttttttattgtgcttttggaagtttctatgaattatctctgattaataattatttgtgtttatgtattgcagctaaagcactagagctatttctgcaagatttgtgtgatcggacatatgagataactttgaggaggggggcaaagtgatatggaaaattaggttcaccaacctctccacttcaccaacctctccactacaccaacctctccacttcaccaacctctccactcactatttttaattttgtggtctatatttcaccaatgttactataaataccccatcaataaggcattgtagacatccatcaattcaaatataatcttaagagtttttttctcttagtcttctttgttctttgagctcctctgtgccatatttggcatcagagcaaggttccagagtcaagggaaagcctgaattcgagccagaggttcactttcgagttttccggcaaacatcaaatctgccagacatcgaaagccccatctctgatcatttttttggaaaacggacatcaccatcgtgttcagaaggtccaaaaacctaggacaggagaagcccgccaccgtgaaacgccgccacgcgccgccccacgcgccgccgtccagcaccacgcgccgcccgcgcctgcctgaggttgaagacgaccacgtcagcgccacgtcagccaatcagattgcgccacgtgtccagtcaacgccacatcagcaaaagtctcccctgcccagtcagcgtgccacgtacctgccacgtcagccattcagattgtgccacgtgtcagtcaacgccacatcattacgagtctcccttgcccagtcagcgtgccacgtcacctgccacgtcagccactcctccaatccaaagctgccacgtgtcagtcaacgccacgtcagccactcaggtactgccacgtgtcctgatcgtgtaatttaaaaaaaaaaaaaaaggttgcagaaaagcccctataaatgccagaattccaaatttcagtccctacacttcactaaaattaccattttacccctacacttcctaaaattaccatttttacccctacattgcataaattaccattttaccctccactttataaaattacaaaactaccctcatacttcctaaaacccccacaatggcccctagacgtagaccaactcacgaaattgtaattgaagaattgaggcaacaaattgaacagttgcaggcaaccgtaaatgctcaacaaatacaactagaagagcaaagagcatcccaaagctacgattctgacagtagtgattccgcatcaaccagaaatcgtcgaacgcaaaggcaaaccttccgatcagacgatatcagagtggacatcccagaatttgaagggaagctacaaccagatgattttgtagactggctacaaaccgtagagcggatattcgagtataaagatatacccgaagacaaaaaggtcaaaattatcgctctcaagttgaaaaagcatgcttccatctggtgggaaaacttaaagaagaagcgagcaagggaaggaaaaagcaaaatccggacatggacaaaaatgagaaaagaattgaatcgtaagtttttacctattcattttgttcaggataattttattcaactacagaatcttcgccaaaagaacatgtctgtagaagaatacactagggagtttgagcaattaatgatgaagtgtgacattcaagagagagaggagcaaaccattgcccgctaccttggaggtttaaatgctgatatcgctcaacaagtccaactccaacaatatgaaaccgtagatgatgctattcgactgtccatccgaatcgagaagcatcagcccagaaggtcttcatatcaaccttcctcctcttttccctacaggaatactacaaatattcacagaccacaaacccaacaaagcacatcaaataaccaacaaccagtccgaaaccctcgtgcgtccaacacctccaacaacaaccccccaaaatccaatacagaggtcaactcgagagtgaccaaatgtttccgatgccaaggatttggacatattgcttctaattgtccaaaccgtagagtcattaccatcatcgacggagaagcccatgaagtttctgaaaaggatgaggaaccaatctttaatgaaggacccatctttgatgaggaacccgtatatgatgaagaaaccacccctgctgatcaaggcgaactactggtggttaggcgtagtctgcatacaacgacagttaaagaagagtcgtggctaaggcacaacatcttccacacccgctgcactacgcaaggtaaaatttgcgatgttatcattgatagtggaagttgtgaaaatgtcatatccacttacatggtggagaaattgaaattgccaacacaagaacatcctcacccctacaaattgcagtggcttaataaaggaaatgaggtgaaagtttctagacgatgtcttgtgaatttttccattgggcagaagtaccaagatgaaacttggtgtgacgtaattcctatggatgcttgccacctcttactaggaagaccatggcagtatgaccgacgtgctctattcaacggttataccaacacttactccttcatcaaaaatggagtaagaatcaagttaacacctttatccccaagtgaactaaacaaggggaagaaggaatcaaagcctctcgaggttctcatttctaggaagcaactcagattgtccacagaagaagctcataacacgagccttatcctcgtgtgtgaaacctacaaggagacagttcttccgcaggagattaaggaaatactagctgactttaaggatgttgtacctgatgagattccttatgggttacctccggagcgagatatccagcatgctattgacttcatccctggagctgtcattccaaataaaccggcgtacagaatgagtcccaaagaacacgacgagattcaacgccaggttgaggagttgcttaaaaaaggattgattcgagaaagtgttagtccttgtgcggtaccagtcctcttagtaccaaaaaaggatggtagttggagaatgtgcgttgatagccgagctgtcaacaaaattaccatcaagtatcggtttcctataccgcgacttgatgatttgttcgaccaactgcatggagctaccctgttttccaagattgatcttcgtagtggctatcatcaaattagaattcgtccaggagacgaatggaaaactgcattcaaaagcagggatggtctctacgagtatacagtaatgccttttggtttatccaatgctcccagcactttcatgcgtctgatgaatcaggtactcagaccttttattggtaaattcgtagttgtttactttgacgatattttggtctatagcaaaagaaaggaagatcatttggaacacattcgtcaagtcctacaaacactacgaaagcaaaaactctatgccaatctgaagaagtgcgcctttcttaccaatgaagtaaacttcttgggatatgtaatcactgctgaaggcatacgagtggataccagtaaaattgaagccatcaacagttggcctattccaaagtctgttcatgatataagaagttttcatggtgttgcgatttcacggcaagtgcaccgatcgtttaacaagtaataaagtgagtaagtgagttatcgtctccacagggattggggtaattttcacaataatgttaagaatgtgattggaagtgaaaatagaaaattatgcagaaagagtgttgttgattgattggttgttgtattgtaagacagaatttaaacaaatgcagtaaattgagttaattttaccaatgagagatgaattgtagtcaggcgcaatcccttctgagtcttcctcttttacttgactgattcgttaaattaagttgaagtgcacatatgataaatctttcctataatcgtgaaacctagataactagcgagtcaaccctttaattgatcaaagaaccctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaacaggaaacagaatcctattcacgctatcagcgcgcgactccacgctaatagcgtgggtttctcaaaagtatgacgcgattagcgtcgcctttcacgctagtagcgtgacttagtcgaacctccagactgcttccatgcttccttcacgctaatggcgcggattttcacgctagtagcgtgatctattcgagacatctggctttgattcgtcttgttgacgctaacagcgtgaggtttcacgctaatagcgtgacttggtcgagaactcaactcctatttccttgcatctagcgctggtagcgtgaattctcacgctaatagcgtgagacttcacttttggttttctctctttgcttgattttcctcctttttacctgcaaaatactcaaatgatattgaaattagttttaaacaattagaatgctaaactagcctaattctattctaattcatatatatttaattaaaatctaagttaaaacgatgctaaaaactagatgtgtttgcaacacatcaaacaattcccagatttgaaagttgctgtcctcagcaacagagagaattctaagctttaaacaagaattaacaatcaatcacaaactacaagccacaatcctagaatcatcatgaagtgtatgatcaattcagtcaaaggcttctatgataccttcaatgctgtttaaaatcagaaattacttgagtattcctcacagacatgtgtttcatcactcattcactcaagtgtatcaggctataattaccctcttactcaacataatcacaacattgccataggcttgaaaatattctcaataattgcaagcacaacttgatcaaaaggtctttatggcttgtaatgtggctgggctaagggtaggaattatttggaaaagtagctcaacagaggctagattcagttccttaagtccaaacctgtttgtgatcttcaatgctcttcattctctttttctttttatgtccttcaaactggtacttttattcaactttttattctgaacagaaaataataccataatactttctttttgcattttcagatttttttttttttttttaaaacatttatgaatgcaattacaatatagtaaatactgtagcttatcacttttcagctgatggactgttgctcttcttcccattcacttgatttctcatgctttccatcaatccttgatgccttgtatcttgctgttatgaacttatctcaccttctctagcctcaaaggatcttagtcatttggatatagcttgattcgggttactgaaatgaaaggctaaggctcaaaattcaggttcaaagggaaaatcagttaaggtagtcaatttggccctggttttcatgaaaaaaattgtgccttaatcatttcaagtcacacctgcactcagagaaacaattcaagttctagaacatcatgaaatatggagtctctcggaagaaaaattttaccgtgtttggctcaaaccttacaggtgttgtactcaagtcattctcagtcaactgcatttctgacatcatttcaacattcaacatgagtttcatatactatcaatcaaattctactcatgcatcatgcagtccatgtatcttgtttcatcaagcttaattcgaagaacctgtccattgttaagttcattcgctttcttaatatgaaaaattttgtgtgtgctgcttatttttttaaaaaaaaaattttgaaaaggtttccattagacttcatttgttcccttgattgtgatttgcgaaataatgcgtactaaccattcccagatttatatgttgctgtcccagcaactacaaacaaggtcacggtgcttttgaaaacatggagcattattcgaaaaatcgcattcaatccacattggtctaaacagatttattagaaatttaattataaaccagaaatgtattagatatataactaaatgttcagaatgtaataaaaatatgcataatgtatgttaaatatgcagaattataaatccatgcctaaaataaaatataaacataacagaattataaatgaagacagaaaagataaacataaacaaaaacataaaaaaaatgtccaatatcactccgccgcatcgctgccctctgcagtggcatccacctcagtgtgctcagaagtcaggggctgggtgactgtggtgccaacagcctcggatatgtccaatgggtctgtcgctggtggaccggtgggatctggtggtggagtaggaataggcgtctgatattctgctggatggatgcctaagtgtctgcacaccgcctcccacatccgtgtctgctgtgccaactgggtactctggaactccagttgtgctcggacaaactcctgaaaagcaatgaggctcggagagtcctcatacaatggaatgtgggcaggagctgtagaaggtggcggcatggatgatgatggtgctgctggtggtgatggtggctgggctggctgggctggctggggatcctcctcaactggtacgcctctaggtgatcgagcagctatctcctccggtccgagcttagcggctcggaggacctgctcgtctgctgcagaagacatggcgtccaagtatgtctggtgagtcatgatggtggagatcggcacgtccatgggctcctcctcatcgatatggacacctgcgtgtcggcatagtagaagaataagggaagagtgagctagccaggacttcttaccaacgtcctggaccatatgaaggatcctgtgggagaggagagaagaaataagaagattgctgtctccacggaggatgtacagcaggatggctcgctccacattcacatcagtcatatttgtggatggtatgactgtgtgattaatgaactgatgccagaatagggcatctcccaccaaatcttgcttccgcagcttctctggtatatcatcaagcccaggtctgggcttccatgaagcatagagaccagtgatggccctgcggatggtggtggcaagctcgggaacatcgtccctgtacagctttgtcaaggcgtccggctgcatgcggaagaagatctgggtgaattcgcaattcgcaaagggatcataggcggtgtccagaatgcgctcaatagtgcgggaatcaaatggtacccggacacccctcacccacaatgcctgagtcctgtaaactgtgtcttggtctacattagccaagaactccttcagaatcatactggagcttggctccgcgaaactgacgagacgctgccactgccttctgatgatcacttccttgatagggctatcttcaggcaacgtctcccacataatcttcttctccttaataatccgttttgggaggtaccaagagtcgaacttctcttggcactccacagtcctgaagcgcaactcatcaaaatctgccactctggctcgtttcctactgctctctccggtggctttcttcttgccctttgctatttgtttaccctgaaactcagaaaagaatccaaaaggcatatatagatgttagagttttagaattcccagatttaattctctttatgtctcagatcaatgaagtacaagtaatcaagatgtgggttccttaaactcagttcaaataataatttctgggtttaccattcccagctttaggcaatttgatcatattgatattaagagttcaggtcattcatgacaataaaaattcaatgcacatggttcagtcatcataaatataaatcaatgtaacagtgcagcatacaagactttgaaatcactgtggtgttttcaatatcagcccaacaattcccagatttaatttcttagtcatccatcaatcattccaaaattcaatatcaaaacgcataaaaattagcacttatctacttagttcaatcccaccaatattcatctaagtatctacccaatttctcagtgaagttcccattcccagatttaatttcttacatatatcaacaatgttctattcaatcatattatgtagactgtgtttcaatttcaacattggaatccatcattggaattcccagatttagcaagtcgaatactcaaggcaataaaacacagtcaagcatgcaaaataatttgaattttcattgtgtccatcttatcctaacaactgcaagtacaactttattagcacaactaaaaattgcttaacaggtgattgctaattgcaatgcaattcaagtttcaattatggcacagctttgtgttgacagtcttaactgggatgaaatgaattcccagatttaggtgttgagggatattcagtttacaattgttcaaccacaccatccatgcttgcttgaccactcacatcaaaactgcataattatctataagtccatgcaatttccattcattcaaagtctaatggtaattatagcattgcttgcttagtccaattgttagcattttctgcatgttcaatttgtagcatattgtagacaaacacatggacgcattcatgtcattcctagaaagttttatcacttgcaatttcaaattatatgccattctcatctagttcaattcaagctatgttattgtaccctaaaccaaccattcaaagcaaaattggtagcctaatgcttagagctattcaagataaccaagactgatcaataatgagtcaatttttcattcaggcattttagcgaacacttggtgggcaagaaaatcaacacacatgatgtgtatgttaggcatatggaaaatccaaaaaattttcagtttaatcagaccacagacaaggaagaagcaggagaagcaattatctatgtcagattccattcaagattggttctctatcttagggttttcaagaacattttcaatttttaaaacatgagaatttgaacaatgtatagcttaatcctataatccttagtacacagcaattgaatatcagttacttaccttgtcgcctaccatgatgcacaaagactttgatgaatgccacagaaacctcgtaatatgcagaaaatgagaacaaaagcttgaagaaggaagatatggtggtgcagttgagagtttaagtgagtaaattgaagttttataggtgaattggggactgagggaagttgagggaagtttatggaggttgagggagtttgggcgagagaaggggagtgatttttgggataggaaggaatgaggcgctaagtggggaatttaaaaataaaacagtttccgcgacctcacgctattagcgtgagacttcacgctaatagcgtcgcatggcactgaaaagcccttctggctcgaacatctcacgctagtagcgtgagattccacgctagtcgcgtgaatgggcactggacagccctggagtctcgaacagttgacgctattagcgtcacttctcacgctactagcgtgaaatttagaaattcagacaatttggttcgaacaggtggcgctaatggcgccagtttcacgccattagcgtgaaagtgcttggtagtctcgaataactggcgctgatagcgccataactcacgctatcagcgtgagatcatgcagaatgggggtctgggctcgaacatctcacgctaatagcgtgagatgccacgctaatagcgtgttgtttcctgctttgaatatttctgtgctcaaaagctgaaggatactgctaaataatatcctaaacctaaaatgcagcataaacctaaaattaatgaatcctaacaacgatttaagcctaatatgaatgtaaaaattcccaaatgggtatattaactatctattatgcagaagaaaaacaaagagtatgcttctaattttaaatcctaatttaaaatctatatacattaccagagcttgtttaacgtctcagctagacgcatgcatcacttgaaacctcagtattattaagtggaacagaagttgaagttctgtccacttctcctccgaagtaatgttttaaacggtagccatttaccttgaatgcgcggtcactatccagaggtgagattgcaactgtaccatatggaaacacttctcgaacaaggaatggtccagaccatcttgacttcaacttgcctggaaaaagtctcaggcgggagttgtacaatagaacttgttggccaggtgcaaactccttgtttctgatttggttatcatgccactttttcgtcttttctttgtagatgcgggcattctcataggcagctaatctaaactcatctaactcattcatttgaagcaatcttttctcattagatcgggttagttcaaaattcaaaaacttggttgcccaaagtgctttatgctcaagttcaataggtaaatgacaagccttaccatatacaagctgaaaaggagacatgcctataggtgtcttgaatgcagtcctgtacgcccacaaagcatcatccagcttcttggcccagtcttttcttgatgctccaacagttttctccaaaattctttttaattccctgttggagatttctacttgaccacttgtctgagggtggtatggggtcgccactttgtgtctcactccatattttgcaagcaagctatcaaattgcttgttgcagaagtgagttcctccatcactaataatcgcccttggcaccccaaatcttgtgaatatgttctttcttaagaacgaaactaccaccttggcatcattagtgggtaaagcaactgcctcaacccacttggagacataatcaacagcaaccaagatgtattgattagcaaatgacttagggaatggtcccataaagtcaatgccccacacatcaaaaagttccacctcttggatgttgttcaaaggcatttcatctcttcttgacacattacctgtcctttggcaattgtcacactgcatcacaaagtcctttgagtctctgaatattgttggccaatagtagccacattgtaatactttttgtgcagtccggttagctccaaagtgtcctccatagcttgatgaatgacaatgccatagaatggttgacacttcactttcagctatgcatctgcgaatcacattgtcagcacattggaaatatagataagggttatcccataaatacctcttcgcatcatgcagaaacttctttctctgctgccatgtaagtgtttcaggtatcactccagcggctttgaaattggccatgttagcaaaccatggagtaagttgtacagctaacacatgctcatctggaaagaattcgttgatttcaacttctggtccatcttgcaattcactatgctgaatccttgacaagtggtcagctaccttgttttcaacaccagccttatctctgatttccaagtcaaattcctgcaataataacatccaccgcagcaaacggggttttgcatcttgtttatgcagtaaaaattttaaggctgcatggtcagtataaacagtcaccttggaccctactaagtatgatctaaacttatcaagggcatacacgacagctagcatttctttttcagttgtggcatagtttacttgtgcctcatttaagattttgctagaatagtaaattacatgcaagcgtttttctttccgctgtcctaaaactgcacctactgcatagtcactagcatcacacattaattcaaaaggtagactccaatccggagctattaatactggtgcagaggtgagtttctgttttaaatcattaaaagcattaagacaagcatcattaaatacaaattcagtgtccttttccagcagttggcttaagggcttggcaatcttggagaaatccttgatgaatcttcgatagaaacctgcatggcctaaaaagctgcgaacaccactcacattaataggaggaggcaatttctcaattactaacagtttagctctatctacctctattcccatttcagatattttgtggcctagcactatgccctctcttaccataaagtgacatttttcccagtttaaaaccaaattagtttcttgacatcttttaagaactttggctaaattggttaaacatgtattgaaacaaggcccaaaaacagaaaagtcatccataaatacctcaagccctctttctaccatgtctgagaaaattgacagcatacatctttggaaggttgcaggtgcattacacaatccaaagggcattcttctatatgcgaacactccaaatggacatgtgaaggcggtcttctcttgatcttccggtgccactgggatttggttatatccagagtaaccatcaaggaagcaataataatcatgaccagccaatcgctcaagcatttgatccatgaatggaagtgggaagtggtctttgcgagttgcatcattaagcctccggtaatccacacacatcctccagcccgttatggttcttgagggtatcagttcattcttatcattttgaattactgtcatccctcctttctttggaacggtttggactggacttacccatggtgtgtcggatattggatatatcatacctgcatccaaaagcttaacaacctcctttcttaccacctctttcattgttggattgagccttctctgaggttgtctcactggtttcacgtcagtttccattaaaattttatgagtacagaaggaaggatttatacctttaaggtctgaaatagaccagccaattgctgacctatgctccttgagtactttaattagcttttgctcttcatgccaatccagtcccttattcattatgactggatatgtttccttttctccaaggaagacatacttcaaatgttccgataattctttcaattctacctttggtgcaccggatggaatgtcatcttccttaacttccagctcttctaactcattctctgctgatttttctgcagctgcatcatcaagtttaacttggctttcctcagctgcattttgctttgctgcataattttctgcataattggttactgcagccatttctgctgattttgcactttctatggcttccaaatctgctgtaattcctgcacaaacagcgttatccaacacatctaatcgaaagcaatcatgttcatcagttggatgtttcatggcatcaaatacactaaacacaactgactcatcattcaatcttaattcaagtttcccttgctcaacatcaattaaggccctagcagtggctaggaaagaccttcctaaaagtaagggaatttcactttccccttccatatcaagcacaatgaagtcagcagggaatatgaacttatctactttaactagaacatcttcaatcaccccggagggtgttcttagggatctatccgctaattgcaatgagactctagttgatttaagttcagttatgcctagggacttacacatagataatggcataagatttatactagcccctaaatcacataaagctctccctacattaatgttaccaatggctatagggatattaaaacttccaggatccttcaatttaggaggaagtttcctttgtataatcgcactacactcttctgtgagcgctatagtttcacactcctgcagcttgtgtttcttagaaagaagttctttcatgaattttgcataattgggcatattagccaatgcctctgcaaatggtatattaatgtgcaacttcttaaacatgtctaaaaacctggaaaattgttgtttctgtagttgttgctttgttagcaccggatatggaggcttctcaaagcgagaaaagtcccacttctttggttgaggtgcagattttggctcttcaacaatctcctcagcttttttcctctctttttccactgctgcagaatttttctcagcttcctttctactagtttcagccttctctgggggagataataccttaccacttctagttgtgatggcttttgcatgttctctcggattcacaactgtatcacttggaaattggccttgtggtctctccgccatttgtttagcaagctgtccaatctggttttccagatttctgatggatgcatcttgatttgtcctgtgagctcttgtctcagatatgaaatctgcagtggtttttgacagctgcaacaccaccttttcaagttcagaaggctccttgttaggaattggaggtggttgcaaataattgttggacttgtaatccaagccacctccttgaaatcttctctgataattgtttccagctgcataattattgttcctttggtatggttgctgctggaacggttgtggttgctgcctttgatcattccaaacaccatttacctgcacaggatcagcaccaactaaaataggacaaatgttagactcatgctcaccttggcaatactcacaaataatatatggtttgcttgtgcccacttgtgctgcagaaacttgcaagcggtccatcttctcatttaatttggccaattgctgtgctagaagcttttgctccgcaagcattgcatcattagtgtttaactgaataggctccctctttggctgaatggtatggctttcattttcagttcttgccaacgatttgatcaactcatatgtttgtgtggcggttttggatcttatagtgccaccggctgcaatgttgaccatcattcttgtctcaggagtcatgccattgaaaaatattctgacctgtttacctacagacatatcatattgagggcatctccttactaatgcttggaatctcttccatgcagtacatagagtttctcttccactttgtgtaaagttggtgatctcgttcaccaatcgattatatttatccatggagaaatactctgcaaagaatcttgaaaccaaatcatcccaagttgctatactgtttgatgtctgacaattcagccatctcaaagcattgtccttcacagcaaacgggaataaacttagcctcacagcatcatcggagactccttggtgtctaatagtgtcacagattctaaggaacctgtctatgaaatcatgagggtcttccgaatcatcccctccaaactgactgcgctccaccaatgatatcaatgaagggtttatatcaaaatgattggcttggattggtggcctcacaatgctggagttaggccttgtgaacataggagccagaatatcttccataagttcatcttcgggccttggctggttgtttcttgcttcagccatgttttcgttcgactcaaattctggaagtgaatcaaagtcaaacagttccgcttctctccttctttgtctagctagcctccttcggagtgttctctcaatttcaggatcaaattccaatccctcagagctagctgtacttcgcataaaacttaagagaagtggttagtaacaaaagttcaatcacaaagtttaacaattactgaaaaatctgttaccaatccccggcaacggcgccaaaaacttgttgggatttcacggcaagtgcaccgatcgtttaacaagtaataaagtgagtaagtgagttatcgtctccacagggattggggtaattttcacaataatgttaagaatgtgattggaagtgaaaatagaaaattatgcagaaagagtgttgttgattgattggttgttgtattgtaagacagaatttaaacaaatgcagtaaattgagttaattttaccaatgagagatgaattgtagtcaggcgcaatcccttctgagtcttcctcttttacttgactgattcgttaaattaagttgaagtgcacatatgataaatctttcctataatcgtgaaacctagataactagcgagtcaaccctttaattgatcaaagaaccctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccctgtgcatccctcaatgctcattacgggaagcaatcatctgggaagcccatgatggaagtttagctggtcactttgggcgagacaaaactgtaagcttgattaaagaaaatttttattggccgagactagaaagagatgttaataggcacattcaaagatgcaagatctgccacttggctaaaaccaagagccaaaatacaggattgtatatgccgcttccagtcccattagcaccttgggaagatgtcagtatggattttatccttggactaccgagaactcagcgacagaaggattccataatggtggtagtagacagattttcaaagatggctcactttattccatgtcagaaaaccaatgatgctgttcaaattgcagacctgtatttcaaagaaattgtccgccttcacggtattcccaaaaccatcacttctgacagggatgttaagtttcttagccatttctggagaaccctatggaagaagatgggtactaagctacaattcagtagtgctagtcatccccaaacagatgggcaaacagaggcagtcaacagaatcttgggaaatcttctgcgaagttttattgggaaaaatttaaaacagtgggatcttcttcttgcacaggttgagtttgcctacaataactctgccaatcaagctacgggaaattgtccattcgaagtagtttatggcactcgtcccctcagtccattggacttagctgtctcatctaatactcaacagtatagtgcagaagctggagaaagggcaaaagaaatcaagaaattacatgagcttgttcgtgaccagatccagaagcagaactttaagtacaagattcaacgagacaagcatcgtaaatttcagactttcaaggaaggggacttagtctggatccaattacgaaaagaacgatttccaaatcagccaaattccaagttatctccaagagctgatggtccattcaaagttgtcaaaaaaatcaatgataatgcctacaaaatagagctgccaggcaactacggggtttcggccacttttaatgttgctgacttaactccgtatattgatgataacacggagcttgactcgaggacgagtcctgtccaacccggggagaatgatatggaaaattaggttcaccaacctctccacttcaccaacctctccactacaccaacctcnnnnnnnnnnttaaacaggaaacagaatcctattcacgctatcagcgcgcgactccacgctaatagcgtgggtttctcaaaagtatgacgcgattagcgtcgcctttcacgctagtagcgtgacttagtcgaacctccagactgcttccatgcttccttcacgctaatggcgcggattttcacgctagtagcgtgatctattcgagacatctggctttgattcgtcttgttgacgctaacagcgtgaggtttcacgctaatagcgtgacttggtcgagaactcaactcctatttccttgcatctagcgctggtagcgtgaattctcacgctaatagcgtgagacttcacttttggttttctctctttgcttgattttcctcctttttacctgcaaaatactcaaatgatattgaaattagttttaaacaattagaatgctaaactagcctaattctattctaattcatatatatttaattaaaatctaagttaaaacgatgctaaaaactagatgtgtttgcaacacatcacatggcttagcttctttttacagaagatttatcaagaattttagctccattgctgcccctctgacagattgcatcaagggagataaattccaatggacagaacaggcccagaaaagctttgaaatgctaaagaaacgtcttaccgaagcaccactactagcccttccaaactttgaccaagtgttcgaggttagctgtgacgcttccaatacaggaatcggtgctgttttgagccaagaaggtcatcctatagccttcttcagtgagaagctcaccaatggtcggctcaagtattctacctatgacaaggagttctatgctgtagttcgtgccttacaacactggagccactatctgttgaataaagaatttattctttattcagaccatgaagctctcaagcacttgaattcccaacagaagattaatcgaaggcatgctgcctggagtgaattcttgcaaccatacccatttctactgaagcacaaggcaggagttcaaaatgttgtagccgatgccctcagcaggcgacatgcattactctccactctccaagcaaaagtcatcggatttgaggctatcaaggaattataccaagatgatcctgactttagcaaaatttggaatgtgacagaatcacaacccttccaaaaatactatcagcatgaagggtttctgttcacagataaaaccctgtgcatccctcaatgctcattacgggaagcaatcatctgggaagcccatgatggaagtttagctggtcactttgggcgagacaaaactgtaagcttgattaaagaaaatttttattggccgagactagaaagagatgttaataggcacattcaaagatgcaagatctgccacttggctaaaaccaagagccaaaatacaggattgtatatgccgcttccagtcccattagcaccttgggaagatgtcagtatggattttatccttggactaccgagaactcagcgacagaaggattccataatggtggtagtagacagattttcaaagatggctcactttattccatgtcagaaaaccaatgatgctgttcaaattgcagacctgtatttcaaagaaattgtccgccttcacggtattcccaaaaccatcacttctgacagggatgttaagtttcttagccatttctggagaaccctatggaagaagatgggtactaagctacaattcagtagtgctagtcatccccaaacagatgggcaaacagaggcagtcaacagaatcttgggaaatcttctgcgaagttttattgggaaaaatttaaaacagtgggatcttcttcttgcacaggttgagtttgcctacaataactctgccaatcaagctacgggaaattgtccattcgaagtagtttatggcactcgtcccctcagtccattggacttagctgtctcatctaatactcaacagtatagtgcagaagctggagaaagggcaaaagaaatcaagaaattacatgagcttgttcgtgaccagatccagaagcagaactttaagtacaagattcaacgagacaagcatcgtaaatttcagactttcaaggaaggggacttagtctggatccaattacgaaaagaacgatttccaaatcagccaaattccaagttatctccaagagctgatggtccattcaaagttgtcaaaaaaatcaatgataatgcctacaaaatagagctgccaggcaactacggggtttcggccacttttaatgttgctgacttaactccgtatattgatgataacacggagcttgactcgaggacgagtcctgtccaacccggggagaatgatatggaaaattaggttcaccaacctctccacttcaccaacctctccactacaccaacctcnnnnnnnnnntttaaacaggaaacagaatcctattcacgctatcagcgcgcgactccacgctaatagcgtgggtttctcaaaagtatgacgcgattagcgtcgcctttcacgctagtagcgtgacttagtcgaacctccagactgcttccatgcttccttcacgctaatggcgcggattttcacgctagtagcgtgatctattcgagacatctggctttgattcgtcttgttgacgctaacagcgtgaggtttcacgctaatagcgtgacttggtcgagaactcaactcctatttccttgcatctagcgctggtagcgtgaattctcacgctaatagcgtgagacttcacttttggttttctctctttgcttgatnnnnnnnnnnaccctgtgcatccctcaatgctcattacgggaagcaatcatctgggaagcccatgatggaagtttagctggtcactttgggcgagacaaaactgtaagcttgattaaagaaaatttttattggccgagactagaaagagatgttaataggcacattcaaagatgcaagatctgccacttggctaaaaccaagagccaaaatacaggattgtatatgccgcttccagtcccattagcaccttgggaagatgtcagtatggattttatccttggactaccgagaactcagcgacagaaggattccataatggtggtagtagacagattttcaaagatggctcactttattccatgtcagaaaaccaatgatgctgttcaaattgcagacctgtatttcaaagaaattgtccgccttcacggtattcccaaaaccatcacttctgacagggatgttaagtttcttagccatttctggagaaccctatggaagaagatgggtactaagctacaattcagtagtgctagtcatccccaaacagatgggcaaacagaggcagtcaacagaatcttgggaaatcttctgcgaagttttattgggaaaaatttaaaacagtgggatcttcttcttgcacaggttgagtttgcctacaataactctgccaatcaagctacgggaaattgtccattcgaagtagtttatggcactcgtcccctcagtccattggacttagctgtctcatctaatactcaacagtatagtgcagaagctggagaaagggcaaaagaaatcaagaaattacatgagcttgttcgtgaccagatccagaagcagaactttaagtacaagattcaacgagacaagcatcgtaaatttcagactttcaaggaaggggacttagtctggatccaattacgaaaagaacgatttccaaatcagccaaattccaagttatctccaagagctgatggtccattcaaagttgtcaaaaaaatcaatgataatgcctacaaaatagagctgccaggcaactacggggtttcggccacttttaatgttgctgacttaactccgtatattgatgataacacggagcttgactcgaggacgagtcctgtccaacccggggagaatgatatggaaaattaggttcaccaacctctccacttcaccaacctctccactacaccaacctctccacttcaccaacctctccactcactatttttaattttgtggtctatatttcaccaatgttactataaataccccatcaataaggcattgtagacatccatcaattcaaatataatcttaagagtttttttctcttagtcttctttgttctttgagctcctctgtgccacaaagactatgaatgcttttcatttgtaagtgaagtttctattattttcttggttcaaatttgtgtctatgtcaagtctgttcaaggtggttaccaggctgcaggtttctttcttttggagggccgttattactatgtacttataagagcatcagatctgctattctaatgataatgtgctcagtctcaaacaatttccctcttgtgccttctatttatcacatgcacaaacatgattagacatgtaaatgacatctgcagaagcaaatgttgggatggtcttgcttttggaacatgtgctgtttgttctagtatttaccttcactttccagtttctaaaatgtcccgagttacttgcgcccttgcctttgcagaaaacagtgtgcagacttttaatatctttgattttctgaaaggtattgtcagcaaagttcctgatttaggctgttctgttgcaactggtgatgaccatgctgtcactaagaggagatttgtgctctggttaatactcttgttacttaattggaacaagttttcagtatgctgaactttgtttactttatattaggaaagtttctggagatgatgaaaatgacagcgacgaggagctcaagagaaaaaagaaggtaatttatcaactgtattcaattacttcaacagtggttaccttaaatttttcctgtgtgattaaaccttttgctgagtaattatctcttctccatgcacactgtgaactttttgctggatacaaaaaaatttacttcagtcaatagggaaactcactagtggcttgtgaatgcacgtttgtctaaatgtctaatagtctgtgaggctaggccacacttcaacttaaagcttactacacaaagtgccaacactgtctggttttctgaatactttggctgaaaactatagaattggcactaaagaacttggcagctgtttaatattaaatattatctgacttatggaactttttttttttcatgatttgcacagccagagcctggacataagagtggcagaggaaggggtaggggcagaggtaggggttgtggccgtggaattagaactgtagatcaaaagatgagttcacatgccaagtgtgaagatgattctgatgtattgaagcagaatgacaaccacattcaaagcaatgaaagcatggaaaatgtgcgggaacctgaagaagttaagcagagttttccagtaagcaaaccggctgaagtgtccattcgaaatttttacttaaatttgaacccagatgaggatatggattcattagacacaccaacttctatcccaactagttcatctgcaaaatcagattcagaagagaagcatgaggaataccctggatggtccttgtctgaaatggaaaaaaataaccatttgatcccattcaactagcgaacataaatggaaggatgatgaagatgaagaggattatgatgaagaaatgtagatgaacctgtgttggtttattcattacttctcatataggccggtcattagaatgttcttatggggaattagagtagattttgtaggagcagtgttagatagatacttactcctttgtagtttaggaagattaggagggatagggcattgaatactctccttataaccttgttttaggttaaaagtggagatatagattgttccaattagaaatagcgatttgccagtatagttatgacttatgagaaattttaatctcatgtaggtattgcttatggtagacactacattcagattttgggtatgttatggctcaaaattttacggggatgcctatcttaatcatacttgtatctagcggaaccaactcactgctccagcaacatgatttgcatgcaaccttttgaatttttgttatcgtgaacttattgcacgatgagacaaagaggaaaagaataagacgttagacggatataaataaatacgaaataaagtaaaaaagatttgttatttagatgaataaaaatagaaaggaaacacgtgtagaaattcattatttatgtttgttttggaaaatgaaagagaaaatacaagcagataaattgtttgaaaaaattatacattttttaaaaattatttccattatttttctaataagatttttttttattatttaatatacttatttgatttttaatatataagctccactaatagcttcttttgtaaaaccaatctcacctcaaactagtttgattaaacttaaaataagtaattataaaataaatattttttcaacaaataaatttaaacaaatttaacaaaagaacatcacttaagttacgagcgtgagttggaccaattagctatacaatgtgggattgtgcctaccatgttggacttgtgtccatagacacatatcagacagctataaagaattatttgaataattaactattcaatgtgggacttgtgactaccatgaaatgaaccttctctaaggtggaacataaagaatgtttttatggttttgaatctatttggaatactaataagaaggacgtgaaactaaaattccaaagtacaattaacatgatactagctctagatacacatgcttacataaaatgcctccgtccctgattggagatatatgaagtttatatttaatatggataattcttagaaaacacagaatagtcgggggtcaatctcaaagtttagaataactataatttcttattaaaatgtcaatctaaatggttcttaacataataagagtggttgtgacatatacttgaagtttgagtttgccagagtctataactatgtaatagacactggcaagtgttcggatggaagataaaatctagaccacaagtgtttgtcaaaaaagttaaatggaaagagaagaaacagaagtattggaaaaacctccattgaacccacggcataaaaaacccacagcaacggagataaaaagtaacacaaactgcattaaactcgctttctgcaaatcttgatgaggtgaaatttgacaagaatgagagtatagacgcagaagaagtgaataatgcgactgcatttgtcaatacgctcattggttgggatcaaataatgtcaatgcataacttgattaatcttttaattaccacttaataactattataagttaattttttttaagttatgatattaaatataaaaggaattgacctagcttgaaccacgcgagctctctttgcatttgaatggttgctctaaaactggacaatgctttgaattcaagtggcagatgagcagctaagtatagaacgttgttatcttcattgtccactgctcgtactatatgctctatcttttttttaagtatactaaaaaaatgcttatatttcgatatggggcagccaagtgcagtaggttccgtccattgttgggggtcccttatcatggtcactagtttattttatattaggaaagatgatgataatgacagccacgaggatcccaagagaaataacaaggtaatatatcaattcagactgagttcgcttaaatttttcttttgtgactaaaccttctgctaagtaattatctcttgtcaataatgcactctgtgaaccttttgctggttacaaaagaatttacttcagtcattcgggaaattcacaagttgcttcactgacttgcaaatacaagtacatttaatactctgtaaaccttactatacaaagaaccaaaactatctggttttcttaaaagttttggtgaaaactgttgttgtaattgagcaaactattcactatagaatcagaactaacacataatgtggaaattctagctgagagatgcaacattctaaagaacctcacagcagcttgatgttaaatattatctgaataatgatttttttctttcttcagagcctggcattgcagtggcagaggaaggggtatcaatgtcagaagagaagcatgaggaataccctgaatggtcattctctgatacggaaaaaatgaacattgatcccatgcaactagctaattaacttaaatggaaggattgatgaagatgaagaggattatgatgaagaaatgtagatgaacctgtttttgtttagaaagttctaattgagaattagagtagaatttttaggagcagtattagacaaatccttagtggttaggaagattaggagggataggacattggaaactttagtccttacaacctttgttttaggataaaagtggagatatagattagaaatagccacggtattgttatttgacaaattttaatctcatataggtcttgcctatatgaggcactacattcagatccttaaacttacggatattgattttgttagggttgttagctttgattgaggcgttgtgtatgcaagtctgttattatatcacatgatgtttcctgtcgagtacaatttgagagcaaatctgcggagcaaactcactgatccgacgacatgatttgcacttgaaccttctttgatatcttgaatttgatgagaatcagataaatggaaaagaaataagagagatataaataaaagtttaatatctatgtactaatactatcaacataaaacaattttaggattttacaaactatcatccaatcaaaaattcaaattttaaacattaacaaatttattatatatacacaatgaattatgatcggatgactatgtaaatctttttacactctcaatacacaactcttatctaaaaataaatacaaaataagatgaaaaagatgtattattaagatgaatataaataaaaagaaaaaaatataaatttttatttgtttgaataaataagagagtagaaaacaaaaatatggttattgcaaaaatgttcatacaaataaaaaataaaatttaatttgaaaacctgaaccttttaattatttcgttatttctcaacataaaaatattttgttataaaacaataatttgattttttaaaattcaaacgtaagtaaaagagcactgctaaccatttctccctccatttcacgtcacttgatgagaaatatggtttggttaggactcattaattataatttcatttctcattttctaacacattcaatcaagaatattttttattactttatttctcttcattttaattttatatttattataattttgttgtatatagtaattcttgtcagatcgagtaagattaagtctcagtgaaagatgaatctgtaataaaaaaaaagctttttctgtgttatgatttgttcccttcaccaaccacatgaaaggaaggggaaaagctttgatgtgggttatgcagtatagtctcaaattaaggcgggaacaataagaaatgtaatatttcatgacatagaaaatatagaataatctcaaatttaaacacaagcttaattgttccacaaacaaataataatacaatgtcttaaagttatgccaatgtctgcaactctgtaataagttagtccagtttgggcaaaagataaaatctagaccacaagtgttcgttgaaaaagctaaactgaaagagaagaaacggaagtattgggaaaagccccattgaagccactgcataagaaacccacttggaagtgtgatcaaatatcaaaaaggaggctgcagtgaaagccacaaccaaagcagcaacggccataataagtaacgcacgcccaaaagtcaagctgggatgtagtgatttcacaaattcgctttctgcgaatcttgaagtgaaatttgacaagagtgagaataaagacgcaaaagaagtgaataatgcgagtgcatttgtcaatatgaagacagtaaaccacgcattggtcttatcacctggaacagtcagagcagctgcaaatgctacggtagcaacaagtgttgacacaagcatgccagattcgaccattcctttggctgttttcttaatttcttcagataacttcttgtgttccttataaaatacattaattggtctcatgcccgcgttgtttctcattgttcttagttcatcaggaacattccgctccactaactatttacaaatcaagagtagacgtaaatgatggtttccaaatgcataatttaattaatcttttaattatcactaaataactagagcaaattacaacaacacctcctaatatttagagtaattacacaaatattttttgagatattagagtaagttttgaggggatgttagtgtaatattctcaaacatataagagatgttagtgtaatttttcaaatttaaaagaaattagtgtagaaaaataaaaaatggaattacatataattatatgaaatctcaaggaaaattattgtaatttcctcaaatagctattacatattaaatttttaagaaatacaatttcaaagttaagatatttaaaaaataaatcttaggggtgatatttatttttacaaatgcacttgtattatttttaattaaaattttctattatatattggctgtttaactattatgctaaagacaattgataacaaatattaaaaaattattacaataatcaacaaatactacatacaatgatttctatttttaattaaaacttgttacttttaaagatttaaaatcagtctagttaacataagcctaaaattagtggaattttaaatttttaaaataagatagctagaactgatcgatcccatgcgagtgaataaagaatggttgaataaagaaaactaagcaaattaattgaccttgaaccatgcgagctctgtttgcatttgaatgcttgctcttaaacttgacaattcttcgaattcaccttgtggaagacgcgcaaccaagtgtagaatgttgttacctccatagtccactgctcgtcctagaagctctcttaattccggtggtataatattaaatattatttcttgtcgaaatagcacaaccaagtgcagtaggttccatccatttctgcggtccctataagtcactagtctaggattattgtcaagaagcatctgcacagccccaacatctcctgattttattgcatattcacgattctgttccaatgtttcaacttgagtcaatacttctccaaatagcggatggtctgattccatggcaaacatcaatttgtgttattagaataactcaacaaacatcaaataccattattacactggatatagataattaaggactaattcttaattttatataaaacaaaaaaatatataactttctaaaatcaaaatcaaaatggaaatgatgtcaagatctaaattttatcttagaacacacaaaaaataaaaatccattttcaacttgttaaaggttacctgacattcctctaggcttttcccccagcatcttcactgctgtaacgtcctcttcattgcttgaaatggccaaagcagttggatggttttcaaataatcgtcttgccgaatctgttttatgcacaaattaaatagtacaaggcaaggtaaataaaaactcgaactaaattgaaaaaccacgtacgagttcatatatatctccttatatatatatatatatatatatatatatatatatatatatatatatgaaatcaatgagaatttagctaggacctgtttggttttaaaggatgatatcacagtctttcagaaacctaatagtcataattaattatttcaactgattcaatgggttcgattcagtttgtaaaacttcataatatgtaaaagagaactagattacaaaaaggagaaataaggttgtttaactagttttacacttaccaaacatgtcgaacctaatggtcattgaaaacagtcgttcaatataattgaaatccattatgtcaagcacttcctgtgaggacaaaatgtgcactattctgttggaatcatgagcagccaagtgaactggaagcatcccctctgagtttggtattagcatgtcttctggcctcatacggctaaccaactctttcacaatttcaagtctgctttcccttgctgctagatgaagagctgtgtctccatctgagtttggtattagcatgtcttctggcctcatacggctaaccaactctttcacaatttcaagtctgccttcccttgctgctagatgaagagctgtgtctccatatgagttttttattattagcatgttttctgggctcttatagataaccattttcacaatgtcaaggctgcctttacttgctgctagatgaagagctgtgcttccatatgagtttggtattagcatgtcatatgagctcataaacttaaccaacacacgcacaatttcaaagctgtttctctctactgctagattaagagctgtgtctccatatgagttttttattattagcatgttttctgggctcttatagataaccattttcacaatgtcaaggctgcctttacttgctgctagatgaagagctgtgcttccatatgagtttggtattagcatgtctactgagctcataaacttaaccaacacacgcacaatttcaaagctgtctctctctactgctagatgaagagcattgtctccatatgagttttttattatcatgtcttctgggatcatatggtcaaccaactctttcacaatttcaagactgccttcccttgctgctagatgaagagctgtgtttccatatgagtttcgtattagcatgtcttctgagctcataaagttaaccaactcacgcacaatttcaaagctgtttctctctactgctagatgaagagttgtgtctccatctgagtttgctattatcatgtcatctgggctcatatggataaccaacattttcacaatgccaaggctggctttacttgctgctagatgaagagctgtgtttccatatgagttttttattagcatgtcttctggcctcatacggttatccaactcacacacaatttcgaagctgtttctctctactgctagatgaagagctgtgtctccatctaagttttttattagcatgtcttctggcctcatacggctaaccaactctttcacaatttcaagactgccttcccttgctgctaaatgaagagctgtgtctccatctaagtcttttattagcatttcttctggcctcatacggctaaccaactctttcacaatttcaagtctgccttcccttgctgctagatgaagagctgtgtatccatatgatgagttttttattagtatgtcttctgggctcatacggttaaccaactctttcacaatttcaagactgcctttccttgctgctagatgaagagctgtgtatccatatggtgagttttttattagcatctcttctggcctcatacggttaaccaactcacacacaatttcgaagctgtttctctttactgccagatgaagagctgtgtcttcatatgagttttttattagcatgccttctggcctcatatggttaaccaactcacgcacaatttcgaagctgtttctctctactgctagatgaagagctgtgtctccatatgaggtttttattagcatgtcttctggcctcatacggctaaccaactctttcacaatttcaagactgcctttccttgctgctagatgaagagctgtggatccatctgagtattttattagcatgtcttctgagctcatacggttaaccaactctttcacaattttaggcctgtttctcttcactgctagatgaatagctgtgtcttcccaagcatttaacggaatgcgtaccatatcaggacatttatcaataatcgatattgattcgaaccactcatcccgccgtatatgtctcatcagatcttcttttaaagaatctgcaatcctttaaaacttcacattataacatgtcctttatataataatcataacttttagtatttagttgcaaagaagaccttttaatttctcgtttaccctaaatctgtaaaaattctcttggaaacttgtctcaaactttgaattcctaataatttcatcatttgtaaattgaaatctagctgagaaattcgagatcatgtagtcaaagggatccaatcatcaatcacctttaattaagtttgaaaattaaatttgaatttttgtttgaaaattaattctatgatgataagtaaaattgtttttgagagaagtaatttattttttcttttcttcagttgacaaaaactaattgatcttaacatgtgacttatttacactcttctacttttttttttatctttcgaataaaagaaaatttttctaaacccattgttgaaatgtaaaataaacaaactcttaagacatgatctctgaaatgcaccctcttgtgaatgcaatagtttaaagtataacttactcagctcttctggagtcatttgattcactcctatactgtcatgttttggtgccggtgagtttgttgaagtggcaattggagtttgctcatgactttgattaggagtatgatctggtggaatctgaattatgtggtcatctgaaacttcggtattggagttcatgatttaattctagggaaaatgaaatgacttggatatctctatgaaattccctgttcgatcagtgttgcttctttctttccagcctgagaagcttgaacatattgtatatggtggtaaaacaatagcccttaattagttttccaacttacacttaaaataattattcctatatgacattttgtggattacagcaatgttcaatctgttcaacacctcaaccctaaagttttcaaaagctttttaagttgaaagatttctaaatttataatattaattcttttttaaagagaataaatatattcattaaatttgttaactgaaaaaaattatacacattaaattatgtggattaattagcgagactcagctatcatgacactgttaattaacttactctcaatttaatgttaactttcttcgttggacaatgatatgatcgatatctttacacacctaaaaagtaaactacacaaactatcccttaagttttgtgaaattatataaactttcttatacctttttaaacatttacaacaatctcgcttatagttataggggcacaaaaaacatgaaaagtttgtataatttcatgaagccctataaaaatggttaatgcaatttatttttttttaaatgtgtaatggaagaaacacttacgcatagagatgttgcgcaaattgactcagtaaaaaaaccttaaccgaaccaatttattcaaattattttgaccaattcattttaaatccaaatagtcaaattacaataggaaattggtttgaaatcgaattagttttataaatattagtttgaattgaattgattttgaattagttttaaatcaattttaaaattagaatagttttgaattgatatttgaattatttaaaaaaaaattgatttggatgaaaataataacaaacttttgtacaacagtgtaattcatctttttttaaaccagttcagattaatcaagtttattttttttaactcccctatttacggatgttttgtgctttcagaacacctatttagtaaccaaaatatgaatgcatatacgtaagtacatgcaaaaataattacaaaacatgtgattaggagcatatatatagtacattatgggtcatttagataaatataaatgtatttcaaaattcaagtattttgtaatgatattttaaatgtgttatagaatagatattacagaacatcttacggagagatgttctttcagcacacctattccataacaaagtatcatactttcaaaatgcatatattatgtaatatattaaaaaataataacagaaagggcattttaaacacctaacgaatatgtattgttcttctgacatacttattaacctatcatatttcccagaatgcgtattccacaatacattaaaaaaataattacggaacatgtaatctagaacaaataatgagaagtattttgggagtcactcttaagtgagaaaggaggtgtaacgtaagttaatttttatagcatgcaggaagaagagaaaagagacaactcaatgttaataaagaaagaaaaaaaagaaaaggaaacacacaaaagaaactagagtggaccaactcaaaggattatgaaaggaaactagcatgcaccacagttatatatatacaaattaaaggttgaaggaaagaaatcatacccaaatgtcttgttaatgaagaacgatggagataaagaaatgcccgtgggatgtgtgaggaggacccttgtcttgtggttgctgtacgttgatcagtgtctgagtgacgagggagcggtttctgagcaatgttatatgcaaagagagtgaatcttaatgagacttaacggtgtgtgtgtgcctgcagatgaggctgtggactatatataatttattaggtggtccggaacaaacacaatcaatatcttcactgttttttatatgacatatagtgttattatttttttcataaattataaactttgaatgcatgttatgtagacattggttgagattatgaaaacaaagtgattccacatacactatttaattaatttctcgtgggtggcatgtgccatgacaaaaaaaaaaaaaattgttcagcccacatgcaaataacgtgtactgattttttgagtggggagaaagcaactgcagtagacaagggaaaacattcttcttctttacccaaaattgtaaccttttttgttatttaatatttcctataccttttgcatttatttaattttttacttatttttatccattttttgaggcgtatatttgaaatgatactttagattagttgtaaagctaagcaaattgccttgttagattcttcggaatgtcattcttttcaccttccgagaagccagaaggggtcctttattcctttgttaaaactactgcttccaagtattccatactaacaaaattcttttcccactaggtgggggtggaatatatggataaaaattaaaaagccacaatgtcttattataattcatgccataacactaatcattcaaatataattaatatagtttttcatggtctctccctatctctaactaatgcgactaccctccatttgatcctgatgtacttcctttattcggattctttagcttttctccacacatatgtggaaaatagacactaattaaggtcttctgtggcccaccttgtgttgttacattagccttgaccccattgtacatttctttgattgctcgaatatagacaatatatataccgtacctttctatctccacaggaccacaaccttaacgttattataactttattataacttaagctatataaaaagtgttggcttaaatctcaagtcaagttcatcccaataaaaaaatattagggtttattcttttgataggtcaacagttaatttaaaaacacaaaagagagaaaaaagagaagagaaagagagcatccaaaattcgcatgttgagaaggacagaaattgtcatccttcaatcttcttgatctccttgtttaatcgttagatcttgttgaaacttttacagtaagtttatgactcaccagtattaacatcttagatagaggcttgtatcatcactcgaaattcccaaaccgaactggttctgaatccgttttctgaagcaagcaacggtattgtgaaggacatttctctcatactaatcgttggatcgcgttcaaactttgaggaatggttaataaaatctgtttctacattctgactgttcggatcattcattgaagtattttcaagagggagtgtttcaactgcaaacagaggttatcagaattcctgctctgttctgtcttgtttcagacagtgatattgagaaagagttatctctttacttaaccgttggattattctcaaatttggtcagtgtgttcctctcttgtagtaattcaatttgaccgttgggatttgtgagttgttaatgctggtggtagaaattaatttcgtacagaaacctattttgtatgtttgtctcttgtaatgttttggtacaacttttgttgaagttgcttgttgattgtaatggttactggaactcttttgtaatctcactttattgatagtgaaaaatttgagtggactccaaaatcgatcccatataaaaaggaggctgcaacgaaagccacaaccatagcaccaatggagataataagtaacgcacgcccaaaagtcaagctggaatgtagtgatttaactaatctttcaattatcacttaataactagagcaaattacaacaacactttatgagatttagtaaggtttgaggaaatgttaatataatgtttttaatataagagatgttaatgtaattttcaaacttataagaagttagtgtaggaaaataaaaaataaaattatatataattacacgaaactaaggagaattattgtaatttgctctaataactatacgtattaaatttgtaagaaatacaatttcaaagttaagatattttaaaaataaatcctacgggtgatatttgttgttacaaatgcacttgcataatttttaattaaaattttctatatatctatacatagcctgtttaactattatgataaagacaatggataacaaattttaagaaattgttacaataatcaacaaatactacatacaatgatttctatttataattaaaacttgttacttttaaagatttaaaatcagtctagtaaacaaaagcctaaaatttgtggaattttaaatttttaaaataagatagctagaactgatcgctcccatgcgagtgaataaagaatggctgaataagaaaaactaagcaaattatttgaccttgaatcatgcgagctatctttgcatttgaatgcttgctcttaaactggacaattcttcgaatatatttcccacggaaattccgatggaatatttcccacggaatatattccatccgaaataattgtatttttcaccaaaattttgaaataaaaatttgaaaacccttcatcttctcagcccacggcccaatctttaatgtggcaccgcgttttgggtgtgcagtctttcttcactttctctttttcaaaatcattcctttgtttctactaattgtcgtccccgccggagatccaccatggctgtcaaccccgccaccacttcctcacttcgacgttgagcgcgagacgctcctccgcaagctccgcgccaagcagtccgcaccgcctccggaatcgccgtcgtcgcgtttaggagtttcctccgccaccgttcatgactacatcgctcataaaatatcccaccacttacattcccttcgaaaactgccacctcggacggcgccgatagcttcacaggtgtggttacagtgaaggtttgaacaaaggataggaacgattctaacctgtgttgatattttgttttgattttgatcagatttggtttctccagttgctaataaggtgtttgatgaaatgtttttaataatgattgtaatttgtgttcatattttgttttgattttgatcagatttggtttctctaatagttgttgataagatgtttggtgaaaggcctcaatcaatttttcaatattttcatattttgaaaatagaagattcttgtaagtagtctaagatgatgtataggccagatcagattcgaaagatggaagagtctaacctaatccgaaaggcatacaaaccagtggagttgatgaaaaaagattacattcaatttctaaactgcattgatgttgcaacaacccatcgttataataacttcaatatttgttgtatctcatccaagctgcagggtctctaaaatctaaattcgcaggcttgctcacttcttataattatcaaatagtttttctggacattgatatgaatgagggtgactatcactgcaagaaattgaatgcacaaaacattattttaagtcttaatgatgcaccatattttatttaaaatcactgtgagtgcacaaatcctatatttatttgtaattattttattcaaaattgaatgcacaaaatcattattttaagtttcaaattttctgcagttaaggtatcttccttgttagagatacgagatattattgcctcacttaaattttgaatatttagataaatattttagaatgagttttaaataatgtttttgttattattgaagattttatcttttttgtttaattaatttaaataaatatgatagaagatagattaggttgttgatttgacatagctgtcaaggagattggaggtattggcttgcatgtttccaagcttgaaagtgcagaagctgctaaacaaggtatctatgttattcacagctaaggatattgtaactgctttctgttaacttggacctctttgcttagttacatttggggacaagaaacattttgaacttgttattatgttgtagttgtatagtttattctatagttttgaatctggattcttacttgcagcttgtgttaattttaactgttattaattagctttcccaagtagtatatgcatatatggattctggctgtatttataatttttgtaaccatgttctaatttttgtagatgttttgatatatttgggtaagaagttgaaaatggagttgctattgggtatgcaaatccattgccaaataaaattgactaacaaatttgtgtgtgtttatgtggctgcccttgcttgtttctgtgcagatttttccttttaatctaccttggaaaatagtttcaaatggattttcttaacttttttcacattcactaacaaatgattttttccgaaggaaacctatattttttgtgatattgacatgctttgggatcattttatggtgctcattgtagatggcctttgagttgtacggtatgcttgctggtaatgttagtccaatgacaggagagaatatcaagccagcctatgcttgttggtatcttcctttttataatatgtgcattttacactttctttttataatatatctctcaatcatctcatacccgccacttatctttttgtgtatttgactttcttaaccacatatctgtttcaattttaaaataatcttaaattttaatttattaaattatttattgtaaattaaaaatatagttaatagactcaagaatattttagtataaatattaattataattaatttataaaactaaaaatatttatttattattaattataattataataatataaaaaattattttttgatacatttgttatggcagtttttttataaccttcagtttaattcagcttgagcggaatgaaattagaagtcacattttatgtcattcaattttattttaaatgtattcatttcatattttatataaattcagttcaatatattcgatgagtattgaatcgatgagtataaattagtagtcccttactctttcctctctccgcttcgaaacatcatcaccaaccttaaccttccgaggttccattccacggttgttaccaacttcttgtcacactctccgcactagatgcatatgaggagttttatggagaaaataggggcaccctttatctgtttgggaaggtactttctcggaatatattatcttattttaatagttttcattttttttaccttttcattgataatacatgatgctacgtgtgttttctttaacctttaatattttagtttttctgttgtcaaggtttcatcaacatggctgtgtaaactatcaaagtcatattgtgaagttatcattattattattgttgaaacttggtttttttttttgaacttgaatcttgatcaatggaaggttgagttgtgtgtaacagtcagttgctcattactgcaaatgagtttgacttggatgcaggaaatgagtctgatgatttgcattctcaattctggttgaaatttaggtcaaaacaggggatttatatcagagttgctgtgttattgtgaagaacatgcagaggtgcatctatgcagttccaaaccgacctttgtgcaaaggtagcagcagggtccttaaaggtatgtttctgcttccatgcctactcttcctgctttactagcattctcctatacaaattagttgttgctaatgaaaagaaaagtatggtccttaaatgtatgtttcttgggaaataaaagtatataaagaaaaaatggtcatttaattttgatatttgtaaattttgaagggttgtaggacctgcttaatgcaatttttaagacttctcacctaaccaattaattagtgcaaattttccctcaagtcgcacaaaagtaaaaccatagtaagataaaagcatttgcatctttgaagctataataaccagcccatgtttccaaaagatttagagcaaaaaatgggattttttcaaaaagaaaattcaataatttcagtagacatcatcaaaagatgttcccaaagaggcatcagttgtgttgcatcatggaaaaataaattcaagtgcttagtggcaataactaaatccattgaacatgattatgcatcactaattgcttctattattcattgcttcattcacacgcagaaaagaaagttaatcaagatgttcttatttgaatgtgtttttgctaatttattgcttgcaactattaactagctatgcttcacctcatttttattagtattagtattatgattattatgattatgatcatgatcatgattattattattattattattatgattacgatgatgattatgattattattagtattagtatttatgatttgaatgaatttgatttttttttaaaaaaatatattctaagacggttctgtgaaaaaccgtcttagaatcctcaatttttttattataaatgacattctaaaacggttattcggaaaaccgtcttagaaggtgtcaactttccagaacaccagaagcgtatttccgacagatttatttgtcggaaatttcctacgggtcattaccgatggatatttctgtcggaaatttccgacggacaaaaaaatccgtcagttaaaatttcatacgagcattttaccgacggattttagtccgtcggaaatttcgtttttccgacggattttcggcattagcgacggattctttcatgtcaataagcatcttcacaacctcaacatttcctgattttattgcatgaaacagcactggcgaagcataatcaggtatcaactccattagaatcgaattacatttcaattcgttaacttgagtcaataatttttcaaatagccgaccagcgtctgattccttgtagtagtcctccatgattagtaagaggtatatatatagttgattggtccaaccaatgtttaacataaatgaaacaaacaaaagtcaaatttaaattttattcttatatatatgaagcaccattttttatctctattcaaaaaattatatattttaatccgtacattaaaaaaattgtaagatatttttgcacatgtgactcatgtgttggcaaacattaatttgtgttattagaataactcaacaaacatctaataccattattacactggatattgataattcagaactagttctttatttttttatataaaacaaaaatatatataactttctaaaataagaatcaaaatgaaaatgatgtcaaataagatccaaattttagcttagcacacacacacaaaaaaaagccattttcaacttgtgagcttacctaaaatttctggaggcttttgcgccagcatatgcaatgctgtaaggttctcttcatttcttgcaatggccagagtagttggatgttttttcaaataatcgcattgccaaatctgttatatgcacaaattaaatagtgcaaggcaaggtaattaaaaatttaaaactccaactaaattgaaaaaccacgtacgagttcatatatatctcctttttatatatgaaatcaatgagaatttagctgggacctgtttggttttaaaggatgatatcagtctttcagaaacctaatagtcataattaattatttcaacattttgaattatggtcaattgtaccgaatgacgttggaattgtaattagcttatggtatctgatcggttcaatgggttcgattcagtttgtaaaacatcataatatgtaaaaaagaactagattaaaaaaaggagaaataaggttgtttaattagttttacacttaccaaacatgttgattctaatggtcattaaaaaaatttacttcagtcaatagggaaactcgctagtggcttgtgaatgcaagtacgtctaaatgtctaatagtctgtgaggctaggtcccacttcaacttaaagcttactacacaaaggaacaaaactgtctggttttctgaaaacttttgctgaaaactatagaattggcattaaagaacctgccagctgtttaatattaaatattatctgaattatggaactttgttttttttttttttcatgatttgcacagccagagcctggacataacagtggcagaggaaggggtaggggcagaggtaggggttgtggccgtggaattagaactgcagatcaaaagatgagttcacatgccaagtgtgaagatgattatgatgtattgaagcagaatgacaaccacactcaaagcaatgaaagcatggaaaatgtgccggaatgttgcgtcaataatttgatgcgtaacttacggcaagtgtaccgatcgttcaagtaataatttgataagtagagtatcgtctccacgaagattgaggcactaatgtaattgtaattgttattttaaaattggaagaaataaaaatagaaataaaattgatatatgattttgtgttgtaatttggaaaataattgaaaagcagaattaaaatttaattaaaaagaaagttatgcagtaatgaagaataattgaggtaaaagctcaatcacctctgatccctacttgattaattgaattgataattaattgcaattactataactactcaaagatatgccttaattaattggttaaacccagattcctcggtctttttaaccctttaatcctaattaagtgttctaatcccttagtaaccctctttcgaattaagctttaagctggcatataaaaactttgcaatccttcatccctatccctaggtaatgtcaaaccgtcgctttatcgctttcagaaactaaaaccccaatatccctattgtgaattaaagtccttagtacctctaatagagtgatcaattctattaatggaatttaaaattgacgaacaagataaagaaaagcaatcatagtaatattcattaatatcaattcaatccacacaagagttcacattggctgttggcctttaccacaattaaggattagccagacatggtatgtctagctcaatacaaataaatcaaagaatagaagagaatgcagagaagaagagtaatcaaacccctaatcttggctttctcctaactttcttgattcttgatctctctcaatgcctccttctcgatgtttctgcctccaggtccctttctgcctctttacttccttatttatagccaaacttgcaaaatcctagtatctttttgttattattttatcttattcagttttcatatttcagttgcttatttattttgattcttttcttctatttattgctcataaatattaaaataacaataattaataataaaattaatgataagataatttatatctatttaaagcctttatttaatattttatctttaatttcttaattattttatcctaaaaactactatatgctaacaacttatcaaataactcccagatttagacattgctgtcctcagcaataaacaaaattttattgtcaagaaaaatatattcaacaatcaagcatttcgtcacatacacaatttcagaactattatgttaaatgcaattgaattccacatgaaaatttcaagaatacttatcaattccatcaacatagaaccttaacttgtatatcccttaccaagaaagataattcactcatcactcaagtgtttagggtaattgtaatctctcaattcctccaaagctataatactaccataggcttgattatattctcaagttcctgaaaataagaaacataaatacatgcacagttgatcaaaaggtctttatagagttgtaacttggcctggcttagaggtaggaatatttggaaagtagctaaaaatcattgagattgaaacgttgatcttctttagactcaattatatttcaatttggaattagttctccactactttttttttttattcatactttttcataatttctttcttttcctccttttgtatttccttcctttcttttcttctttgaacttatttggagacagttcttttctttccttcttcttttgacttttagtggaattcactttgatcactttcgtcttctttttactcaatcaaacattccaatctcaagagaggtaagtcaataagtatggttcaaacagttcatcagatatttgaatagaaaagtctcaagctcaaaagggttaacaatggaagaatttttcaggtaagctaatttggccatggctaaaagaataaaatgcctttatcatatcaattatgcaaatattgtatagaaacaaagcaagttctagagtattatttacagtgaggtcactctgacaataaaattttctgtataggctcaatcctcacaagctatggtatcagtctagattctgttgatttcctatcaagtatcctattcttttcacaatgtacttcaatcataaaaacaagcctagttctaatcatgtccaatgtaattctatactctacttgtttcatacatgcttccaaagacaaatatcattcaatcaaatttaccactgcattggcaattccaaatctgacaattatattatatgctctagacatttattatcctaatttctaaaaattaaacccaatatttatttatttattttattttattattattatttttttattagacatcatttgcttctttgaatgtgaatcatcaaataaacgcatatgcatcccattcccagattttaactattctaagaactggatcgcgtattaattcagaaatcatcattcttggaaccaatatcaatctaacagaatgtattcataatataaattactcgaattttaaattgttccatatgcaacgaaataaaattactgaaaataaaaacagaaattaaaatattgtatgctttctgtttttgcttagctagcttcctgtttcttcttgcagtcttttctatctctggatcaaactgtagagtttcaggttcaactaaacctcgcataaactaaggaaaacagatcagtaaaaacaaaattccaatattaaagattaaattacaaataaattggcatactcaatccccggcaacggcgccaaaaacttgttgcgtcaataatttgatgcgtaactcacggcaagtgtaccgatcgttcaagtaataatttgataagtagagtatcgtctccacgaggattgaggcactaatgtaattgtaattgttattttaaaattggaagaaataaaaatagaaataaaattgatatatgattttgtgttgtaatttggaaaataattgaaaagcagaattaaaatttaattaaaaagaaagttatgcagtaatgaagaataattgaggtaaaagctcaatcacctctgatccctacttgattaattgaattgataattaattgcaattactataactactcaaagatatgccttaattaattggttaaacccagattcctcggtctttttaaccctttaatcctaattaagtgttctaatcccttagtaatcccctttcgaattaagctttaagctggcatataaaaactttgcaatccttcatccctatccctaggtaatgtcaaaccgtcgctttatcgctttcagaaactaaaaccccaatatccctattgtgaattaaagcccttagtacttctaatagagtgatcaattctattaatggaatttaaaattgacgaacaagataaagaaaagcaatcataataatattcattaatatcaattcaatccacacaagagttcacattggctgttggcctttaccacaattaaggattagccagacatggtatgtctagctcaatacaaataaatcaaagaatagaagagaatgcagagaagaagagtaatcaaacccctaatcttggcttcctcctaactttcttgattcttgatctctctcaatgcctccttctcgatgtttctgcctccaggtccctttctgcctctttacttccttatttatagccaaacttgcaaaaccctagtatctttttgttattatcttatcttattcagttttcatatttcagttacttctttattttgattattttcttctatttattgctcataaatattaaaataacaataattaataataaaattaatgataagataatttatatctatttaaagcctttatttaatattttatctttaatttcttaattattttatcctaaaaactactatatgttaacaacttatcacggaacctgaagaagttaagcaaagttttccagcaagcaaaccggctgaagtgtccattcgaaatttttacttaaatttgaacccagatgaggatatggattcattagacacaccaacttcggtcccaactagttcatctgcaaaatcagtgtcagaagagaagcatgaggaataccctggatggtccttgtctgaaatggaaaaaatgaccattgatccgattcaactagcgaacataaatggaaggattgatgaagatgaagaggattatgatgaagaaatgtagaagaacctgtgttggtttattcattacttctcatataggcccgtcattagaatgtttttatggggaattagagtagattttgtaggagcagtgttagatagatacttactccttagtagtttaggaagattaggagggatagggcattgaatactctccttataacccttgttttaggttaaaagtggagatatagattgttccaattagaaatagccatttgccagtatagttatgacttacgagaaattttaatctcatgtaggtattgcttattgtaggcactacattcagattttgggtgtgttattgctctaaatttcacggggatgcctatcttaatcacacttgtatctagcggaactaacttactgctccagcaacatgatttgcatgcaaccttttgaatttttgttatcgtgaacttattgcacgatgagaaaagaggaaaagaacaagacgttagacggatagaaataaatacgaaataaagtaaaaaagatttgtaatttagatgaataaaaatagaaagcaaaaaagtgtagaaattcattatttatgtttgttttggacaatgaaagagaaaatacaaacagatgaattgtttggaaaaattatacgttttttaaaaattatttccattattttctaataagattattatgtaatatacttatttgatttttaatacaccactaatggcttctttgtaaaaccaatctcgcatcaaactagtttgtttaaacttaaaataactaattttaaaataaatattttttgaataagcacttaaacaaataacgttgatcaaaataaacaaaaaaaaatctgttttttaaacataaacacaatttaaacaaatacattaaaaaacagaaaattgtttattttattaaaataaatattttttcaacaaataaatttaaacaaatttaacaaaagaacatcacttgagttacgagcgtgagttgggctattttgacacatatcagacagttataaataatgatttggatatgtgggacttgtgcctaccatgaggtgaacgttatctaaggtggaatataaagaatgtttttatggttttgaatctacttggaatactaataagaaagacgtgaaaataaaattccaaagtacagttaacatgatactaggtctagatacacatgcttacatgcatccgtccctggagatatatgaagtttatatttaatatggataagtcctaggaaatacagaatagtcgggggtcaatctaaaagtttggaataactataatttcttattaaaatgtcgatctaaatgattcttaacatatataataagagtggttgtgacatatacttgaagtttgagtttgccagtgtctataactatggcaagtgttcggatggaagataaaatctagaccacaagtgtttgtcaaaaaagttaaatggaaagagaagaaacagaagtattggaaaaacctccattgaagccactgcataaaaaacccacttggaagtgtgatcaaatatcagcaatggagataaaaaaaagtaacacaggctacagtaaactatctttctgcaaatcttgatgaaatgaaatttgacaagaatgagagtatagacgcagaagaagtcaataatgtgactacatttgtcaatacgctcattggtttggatcaattaatgtcaatgcataacttgattaatcttttaattatcacttaataactattacaagttaattttttaagttaagatattaaaaataaaaagaattgacctagcttgaaccatgcaagctccctttgcatttgaatggttgctctaaaactggacaatgctttgaattcaagtggcagatgagcggcgaagtgtagaacgttgttatcttcattgtccactgctctactatatgctctatctttttttcaagtataaaaaaaaaatgcttatatttcgatatagggcagccaagtgcagtaggttccgtccattgttggggtcccttatcatggtcactagtttactattatcgtcaagaatccaacgaagagcctcatcatttcgatatatagtggattggtccaacaaatgtataacatgagcataaagaaacaagtaaaattaaagtttggtcttatatgaaacatcaattttttgacacacataattaaataaataaataaaacaccattcgcaaccgatcatgaaagcttacttagaatttctgaaggctttcgccccagctatgcaatgctgttaacttctctttttgccccttcatctcttgcaatggccaaatcaattggatatttttcaaataatttcattgccacatctgttacatgcacaaattaaatagcgatggtggattgcatatgtacaaggctaggtaaatctccaactaaattcaaaaaccacgtacgagttcaactagataaaaaaaaaaaaaaggatgtttggttttacacttaccaaacatgttgctgctaatggtcataaaaagcagtcgttgaatatccttataagccattttgtgaagcagattctgaaaggacaaaatttgcaccattttgttgtacatggccaagcgaactggaagcatcccatctgagtttggtatcagcctagaacgattggatctgcaattctaatgataatgtgctcagtctcattaaatttccctcttttgccttctatttttcacatgcacaaacatgattagacgtataaatgacatctacagaagaaaattaaatgttggaatggtcttacttttggaacatgtgttgtttgttctagtgtttaccttcactttctagtttctaaatcacatctatatatgcactaacaatataaaatgattttatataaattatcctttctttggctgttatatattttcttaaaatttggtggaattatggattgattgaacaattgtgcttaattgctctctgttcagggactgcacacggtttaggacaggcattaaatgttcatgaaggccctgaaagtattggtcatcattttggacatttgaccccagtaatgagcctggctattatcaagatcatgccttcggtatttggaaatttggtgttgttgtattgattggatcaaaaaaaatttattaggtgtttttaatactcattaattttatttcctttacagctaatgtaattcaacaagtattatgaaattgtaatgagaggctatcttttgagatcttatcaggcttgattactattttccacatttcgttattggttaataaataagttgcagtttcatttacaaattgccaacattaatgggaaaatcgaaacaaaaaaagcattttaaaaaaaaaattggaacatcaaagtcggttatttcacaaaaaccgactttgtaaataagctttttaagtcggttttctgacaaaaccgacttcaaatccacgatatctaagtcagtttcttaaaaaacccactttgtatcttccttttctaagtcggttttttaaaaaaaccgactttgtattgacttattccacgtcggtttgttaaaagaaccgactttgaaagcacgctatcagtccgtttttttaaaaaaaatcactttgtaactacgattttaagtcggtttttttaaaaaaccgactttgtaaatacagtttctaagtcggtttgtttaaaaaaccgacttcgtttctacatttgtgaagtcggttttttaaaaaaactgactttgtaggttcattttttaagtcggtttttttcaaaaccgacttcgtatcttccgatgtgaagtcggttttttaaaaaaactgactttgtaggttcactttttaagtcggttttttaaaataaccgacttagaatgtgcaatttattaaaaaaaaaaaaataaatttcgaagtcggtcccccagaaatcgacgtcgtaagcttccctcttttacgacgtcaatgtacaaggtcggttcaagaaccgacttagaatgggtaaaagaaccgaccttgaatcctgctgttgtaatagtgaatttattatattacactcttaatacataactcttatctataaataaacaaaaataagatgaaaatgatgtattattttgatgaatagaaataaaaagaaaaaaatataaattttaatttgtttgaataaataagagggtagaaaacaaaaatatgttcattgcaaaaatgttcatacaaataaaaaatcaaatttaatttgaaaaatccgacctttttatttcattatctctcaacttaaaaatactttgttataaaaagataattttattttttaaaatttaaacataagtaaaagaacacggctaaccatttctccctccatttcacgtctcttagtgaaaaacatggtttggttaggactcattaattataatttcatttctcattttctaacacattcaatcaagaatatattttattacattatttctcttcattttaattttatatttattataattttgttgtatatagtaattcttgtcaaatcaagtaagattaagtctcactgaaagatgaatgtgtaataaaaaaaaaaaaaaaagctttttctgtgttatgatttgctcccttcaccaaccacatgcatggaaggaaagggaaatgctttgacgtgggttatgcagtgtagtctcaaattaaggcgggaacaataagaaaggtaatatttcatgacatagaaaatgtagaataatctcaaatttaatacatgacatagaaaatgttccacatacaaataataatacagtgccttaaagtcatgccaatgtctataactctgtaataagatagtccagttaggacaaacgataatatctggaccacaagtgtttgtcgaaaaagttaaattgaaagagaagaaataaaagtattgggaaaacccccattgaagtcactgcataagaaacccacttggaagtgtgatcaaatatcaaaaaggaggctgcagtgaaagccacaaccatagcagcaacggagataataagtaaccaacgcccaaaagtcaagctgggatgtagtgatatcacaaattcgctttgtgtgaatcttgatgaagtgaaatttgacaagaatgagagtaaagacgcagaagaagcgaataatgcgactgcatttgtcaatatgaagacagaaaaccacgcattggtcttatcacctggaacagtcagagcagccgcaaatgctacggtagcaacaagtgttgacacaagcatgccagattcggctattcctttggctgtatccttaatttcttcggatatataacttcttgtgttcttcacaaaatacatcaactggtgtcttgcccatgatgtttctcattgttcttagttcacccggaacattcgactccacgaactatttacaaatcaagagtatatgtaaatgatggtatccaaatgcataacttaattaatctttcaattatcacttaattaataattagagcaaattacagcaatgcctcctaaattcagtgtagttactatacacaaatatattctcaggtataagcttaaaatttgaagaaatgttagcgtaatattttcaaacttataagaaatgttagtgtaatttttcaaacttaaaaggaattagtataagaaaaaaaaatggaattacatataactacacgtaactcgaggagaattattgtaatttgttctaataactattagatattaaatttgtaagaaatacaatttcaaagttaagataattttaaaataaatcttacaggtgatatttattgttacaaatgcacgtgtataatttttaattaaaattttctatccatatattggctgtttaactattatgctaaagacaatggataacaaattttaaaaaattattacaataatcaacaaatgctacatataatgatttctatttataattaaaacttgttacttataaagatttaaaatcagtctagttaacaaaagcctaaaatttgtggaattgttaaattaagattgctagaactgatcgatcccatgcgagtgaataaagaattgttgaacaagagaaactaagcaaattaattgaccttgaaccatccgagctctctttgcatttgaatgcttgctcttaaactggacaattcttcgaattcaactcgtggaagatgcgcagccaagtgtagaatgttgttaccttcattgtccacttctcgtactttatgctcttttaatgtcttccctgttatactgttaaatattcctttttgtcgaaatagcacaaccaagtgcagtaggttccgtccatttttggggtcctcaaattcacgattcatgtcaatcatcatcttcagaacctcaacacatcctgattttactgcatgaaacagcactggcgaatcattataaggtatcaagtcctttaaaatcccatcacgatcacatttccactcgttaacttgagtcaatatttttgtaaatagccgaccagcttttgagtccttgtcctccatgtctagcaagcggtatacatatatagtttattggtccaaccaatgtttaacatgaaatgaaacaaacaaaagttagattaaaattttattcttatatatatgaagcaccatttttttatctctatttaaaaaattatatttttaatccgtacataaaaaaaattataagatatttttacacatgtactcgtgtgttggcaaacattaatttgtgttattagaataactcaacaaacatcaaataccattattacactggatatcgataattaaggactaattcttaattttttatataaaacaaaaatatatataactttctaaaatcaaaatcaaaatggaaatgatgtcaaataaaatctaaattttagcttagcgcgcgcgcacacaaaaaaaaaaaaaagaagccattttcaacttgtgaaagcttacctaaaatttctggaagcttttgttcccccagcataatatccaatgctgtaaagtcgtctttatcttttgcaatggccagagttggttgttttccaaataatcgaattgccaaatctgttatatgcacaaattaaatagtacaaggcaaggtaaagctccaactaaattgaaaaaccacgtacgagttcatatatatttccttttatatatatgaaatcaatgagaatatagctaggacctgtttggttttaaaggatgatatcacagactttcagaaacctaatagtcataattaattatttcaacaatttgaattattgtcaattattgtaccgaataacgttggaattgtgtatatatatagcttatggtatctgatcggttcaacgggttcgattaagtttgtaaaacatcataatatgtaaaagagaactagattaaaaaaaggagaaagaaggttatttaattagttttacacttaccaaacatgtggatcctaatagtatttaaaaacagtggttccatatccttgagatccattttgtcaagcacttgctgagaggacaaaatgtccactattgatctgttgttgagactttggttgtcaccatatgaagctgcagccaagtgaagtggaagcatcccatctgagtttggtattagcatgtcttctggcctcatacgcttaaccaactctttcacaatatcaagacggcctctctttactactagatgaagagctgtgtctccacttgaattttgtattagcatgtcttttggcctcatacgcttaaccaactctttcacaatttcaagactgcctttacttgctgctatatgaagagctgtgtctccactatcatttaacggaatgcgtaccatatcaggatatttatcaaaaatcgtttgtgcttcgctccagttaccccaaaatatatgtttgcacagatcatcttttaaagaacctgcaatcctttcaaacttcacattataacatgtcctttatataataattataacttaatttcatcatttgtaaattgaaatctagctgagaaattcgagattatgtagtaatcgaagggatccaatcatcaatcacctttaagttttaaatttgaattttaatttgtgtttgaaaattaactctatgatgataagtaaaattgtttttgagagaagtaattcattatttcttttcttcagttaataaaagctaagatcttaccatgcgacttatacatatttatactcatactttaaatgtgattttacttttttatctttcgaataaaaaaagaatttctaaacccattgttgaaaaatcattcgtataataatagtataaatatattatttttaacgtcaagcggtttcaaattctttttttttcaaaatgtaaaataaacaaactcttaagacatgatctctgaaatgcaccttgttgtgaatgcaatagtttcaagtataacttactcagctcttctggagtcatttcattcactcctctcctttcatgttttgatgtcggtgagtttgttgaagtggcaattggagtttgctcatgactttgattaggagtatgatccggtggaatctgaattatgtggtcatctgcaacttcagtattggagttcatgatttaattctagggaaaatgaagtgatttggatacctctctataattccctgtgttgcttctttctttcgagcctgcgaagcttgaacatattatatatggtggtaaaacaagagcccttaattaattatttttccaacttgcacttaaaataactatttccaatatgacattttgtggattacagcaatgttaattgaatctgttcagcatttcaaccccacagttttcaaaagctttttaacttgaatatatgactaaatttatataatattaattcttttttaaagtgaataaatatattcattaaatttgttaacagaaaaaatattcattataaaaaaattatattattaaattgtgtggattagcgagactcgctatcatgacactatgttaattaacttactctcaatttaaaattatatttcttcgttgtacaatgatatgatatctttacacacctaaaaccttcaatttcctactcttatatcgttgacgaaaactttctgccatagcggccggtggttatatatttatccaacttccgttgacgcatttaattatatgattatatcctaactctggtctttttatactagttataatcaattactccaacaaccattgaactcaaagctaagactagatgcattttattatcggaatatgtataaatttattaaactcactccaacaaccattgaattcaaagcaagactagaaaaaaaaatacttatttaacattttaatcaaatctattcagttatattgataataatttttatgatgtttttatctctttatgtatgaaatttaatatattaataaatttgtcataatttttattttcaaaaattaaaattaaaattttcatttttaagaaattaatttattaacattttatacatttaaaaagataaaaataattaataactaacacaatttttataaagtttaggaagacgcaaactacaatgggagagggtaatgggtctcttagagtcagaaagtattttatgaccatcagttaccttgtttaaaaatcaatgaccgtaaatttttcttctttgattattattttccctttttttgtcctcctctttcccgtactacccttttcctctttcttcttctcttctttcccattcttcctctcttcgtctaagccgcaacggtggtgccatgacggttggtgattgtggggatgttgatgtgtcgttgtctgacctttgtgcggagtaaactagagagaactcgagagggtcttgcgttgttttgccacaagatttcaacaggagaaaaagcatggaagacgaaacagtcacaaagcttgatataactattgcctcacttaaacccaaattggattcaattgaacaaacccagattttagtctcccaaagttttgagcttttttatattttttgtgtacgtgttgatttttctcaagggtgtcaagttacgagtttgtttcttgcataaacgttgtttctataccattttactctcaattttgaatccaatttgggagaataaaagacctaagattttggttttgaaaagcaaatgacattttttatgacgatttgtgattatatttgaaattgcagtttcaaggaaattattgtaccatggatatgtaatattttatatttgtaacctggccttgttttctatgtggctctgcagccatagtgaccatctgtggatgtggaatagggaaaaaggaggaaagggcggggttgccgaaaattgctttctgcgtaggtgtcgttgtcagatacaagaaaaatggaagaaaaggaataaatcggcaatggtgatgaataagccagagggataaatcgggaagtcaagaagaaaaggaaaaaattataaagaaaaaaactcatccatgggattaaaatttaataaatctaatggtggaaattcactttccattgtggaagacctattatattctcccacgctagtctttgtcaggactaaattgtacattatgaaacatttaatactaaaaataatattcaacgaaattatagagtctaaatgtatattttatccaaaatatttcaaatcgtgctttgaattagttgttgacacttgacaccttgtttcatactaaattgtgcaagatgtaactatatatataggatttaggatttaaatcatggataataagaaccctaaatcctaaattataaaccacatggaaagaaaaagactttgacatggtgtatgtgtagtttacggaacagataacatggattaattatagtatgtttgaattttggctttaaaattatcatgaaatatggtgagaaaagtcaaatttaattttatataaaacttgttaaatggcttatgactccacctgtattaattttacaatttataattttttataatattataatttttatgtatttaattattatattttaattaataaaatatattattattaatatgttagtatttaagttaacatttttttattatcattataataaatatttatgacaatttaataaaaccatgataataaaaaattaccataattattacagcaacatattagtgttaattaaattataatctatattatctcatgcatcaattatttttagactataaaaatattcctaattaaataagagagaaattatattagcatatatatttagaagagagaaaaacattaatgacaatagtatttttgaaaacatattattttagaacaattttttttactatcaacttagttaattattttttttaatcttaatggattagataattaagtcttataaataggaataaatagtataatatagtagatagtagattttgcatgtttagttattttagtctaatcaattttaattgaaaaaaatatggtgggtggaattaaagtaggaataacttctacttctatcaaaataaattctagttagattttgtctaatttactttcacatcaatacnnnnnnnnnnaaaaattaccataattattacaaaaacatattagtgttaattaaattataatccatattatctcatgcatcaattatttgtagactataaaaatattcctaattaaataagagagaaactattttagcatatatatttagaagagagaaacattaatgataataatatttttgaattagataattgaatcttataaataggaataaatagtataatatattagatagtagattttgcatgtttagttattttagtataatcaattttaattaaaaaaatatggtagaattaaagtaggaatagcttctacttctatcaaaataaattctagttagattttgtctaatttactttcacatcaatactctcataagtatatgtttgtttttttattgatttaaaaacataattaaaattcttgctatatttatagattctagttgttatatttttttattgaatgcattttatctaattagccttgtactcatgtgctaaatcatttagaaaaaggaaatattatatttcagtttaactattgacacatttgagtttatatatatatatatatatatgtatatatatatatatatatattatcaaaataactaattgtaatagaaaaatagtctatatagacattcaaatccgttttgatcatattacaccatcaaaatcaatttaattcaaacaacaccctcttaatatataaatcacttttctgatgttgatggagtatggtttgatactttcaagtgtcaataataaccggtaaacaaaaaactattttaaaaaataaaacgaggtgaaccaatgaaaagatgtgaaaatagtgtgtttgagattgtgattctagtattctttcttattttattgtagacgcctttctcttagatgctaaattttatttttcatcttgtccttaaaaagtaaacaaaggaacatttgtttgcatcacttagtgcatcaattggaaacatttaggcatttagctatttacgcgtaaatacagaataatcaatacgtaataactccaatggtaacatttatttgtagtcgttaatattgaaataggatgccaaatttgtacagccctacaccgtatgtaccattatacagtgtagctgcatatattccatacaatacatacatatagcatgcatatttaatactaccttagatttttttataagaaataaattttagtgtagaatacactacaatttatttctcttacattaccttcgaaggaataatgcaatacatatatatatatatatatatatatatatatatatatatgtaaagggcggatccagccttaaattttgatataaaattacaaatataccctcatcattaaaaaaattcacaaatatagcctttgtgagtctgtctgctatgctctgcttcttcctctctccctgcttcacgcgaccacgcctccgccagcaccacgcgttctgctattctgtttccgagctcggtgcttctgcttctccgcttctaggcttctggttctggactccgaggctgaaggtgaaggctccgactccgaggcccgagctgccggctgcgtgcctgctttgccgagctttggtctccacggctccacgcctccacagtccatctccaggttaagttttgattttgtttctcaatctggccatacatgatacacatattgcatatttaatagaaacacataaacacaaaatcaagcataaccaaaactaaacacaaaaaaggggaattaatgagggttttgaaagagaggagtaccgtgaatttgttgggtcggtaaccccatctttttgcgaaagcggaatgaacctgtgaggagatggaaaattatagaagcagaataatatcacccagagaacacaaaacaattttaacgtggaaaacctcctcaatgtaaagagtaaaaccacggggcactggcccagaaaatcttccactataaaagtaggattacaacaatgatctctctagtacagactagaggtttacaaacaaatttcttcaccctctaaggatggctcacacttaatttttatctctcacttggaggattacactctcactaaaatagtggatcactctattatttctgaggaactctctcttactctcagaattttcttctaatcggtttacacaccgatttctcttaatgctcccgatgcacttgatgcttctaaactgaatgcgtcgctcgctttatataggattgcaaaagatgcaacccatggactttaggctttcggtgcatgtgcaaaagttgctgctgaaactttcggtgcattaaaaaatcagaaaagtagcagccacttgctgctttcggttccttttggtgctggacaacaactgtgtgttgccttattttctaagcaatgggtcccacacattttggaaaaaatgcctcccgtcaattgaggagaaacagccaacaaatctcccccttttcgacttaattagacggggttatcaaaccagcacctttgcagcagtcttcgaacttccatgttggaactgtcttcgtcaacatgtatgaccagttcaaatctgtatgtaccttctcgagatgtagggacttatcttctaactcatctcggatccaatgataccgcacgtcaatgtgctttgaccttgcatggaaggttgcatttttcgctaagtgtatagcactctgattatcacactttagcacgtatttcgcctgactatgacctagctcttgtaggaaacttttcatccacactagctctttgcatgcttcagttgctgcaatgtattcggcctcagttgtagacaaggcaacacacttctggagtttagactgccaggaaatagctccccctgcataaatagtcaggtaccctgtggttgacttccttgagtctccatctccacctaggtcagcatccgagtagacttttaactcgggttttcctatcccaaaacacaaacatttgtttatcgtacctttgagatatctgaatatccatttgacggcattccaatgctctttgcctggatttgacataaatcggcttacaattccgactgcatgagcaaggtcaggtcttgtgcataccatggcatacatgagactgcctacagctgactaatatgggacctttgacatctcgtctctttcttcatcactggttggactttgcttttgacttaacttgaagtgtccagccagaggagtactaaccgtcttggattggttcatattgaaccttttcagaattttctctatgtacttctcctgagataaccatatcagcttctttgatcgatctcggataatcttcattccgagtatctgtctcgctgcaccaagatctttcatagcaaacgacttgctcagggctttcttgagagcattaattttcatcatgtttttcccaactatcaacatatcatctacatagagcaagagaatgatgaaatacctcttgatgaacacgcagtggtctgcttgagtcttcttgaagtcgtgttgagtcatgaaagattcaaacttcttgtaccattgcctgggtgcttgcttcaggccgtataaactcttcttaagtctgcatgccaactgttctttgcctggaactacaaaaccttcaggctgctccatgtatatttcttcttctaagtctccatgaagaaaagcagtctttacatcaagttgttcgacctccaaatcttgagtagctgcaattgctagaacagttcggattgacgtcatcttcaccactggtgagaatatctcttcaaagtctatgcctttcttctgattgcatccttttaccacaattcgggctttgtaccttggctttggattgttctcctccaccttgagtttgtacacccatttgttcttcaaagctcgtctgccctttggtaattcgaccagatcaaaggtgtgattctcgtgcaaggatttcatttcctcttgcatggctttctcccattcttccttttcagcactggtcattgcctcttcatagctctgaggctctccttcttctgcaacaactgtatcttcatcagcaggatatctggtggatggatgtctaactcgggtagattgccgagtttgtggttgtacttcggaatccggttcttggacctccggatgttctgtttttgtctcaccttctgctggtggctcttcctgttgttcaccttcctcattgttttgttggttggtttctccccctgcttcagtatgaataggggagacaggatcttcttgacgaattacagctcgtaccttgggcttgtgtatatcttcaattgtctgatcttccaagaacactgcatctcggcttctcataatcttcctgttaacagggtcccaaagacgataaccaaactcgtcctttggtgaaccgagatagacgcactccttggtctttgaatctagctttgctcgttcatccttgggaatatgcacaaatgcacgacatccaaataccttcagatgctcgtaccttgcctttctgcccgtccagacttcttctgggatatctccttctagaggtcttgaaggtgatagatttatcagatcaactgcagttctgacggcctctccccagaatgccttgggaagcttggcatgtgacaacatgctccggactcgctcttcaatggtccggttcattctttcggctacaccgttcaactgaggtgtctttggaggtgtcttctccaactttattcctgccgccctgcagtacatctcgaatggacctcggtattctccgccattgtctgcacgaacagctttcagcttcctgccggtctccctttcaacccttgcatggaactccttgaagacttggagtacttggtcctttgtagtcagcaaatacacccacacttttctagtgtgatcatctatgaatgtgacaaaataatatgcaccacctagagatttttctgacatagtacacacgtcagtatgaacgagatcaagaatataccttcttcttctaggctggtcaggtctcttgaatgaaattcgacattgtttgccggctaaacaatgggtgcatgtttccagaagttgacccttcaagttcggcaacaatttcttcttggcaagtatctgcaaacctttttcactcatgtgtccgagtcttttgtgccagagctccagacttgattcatctcgcgtggcgttgacctctgcattgtcgatcttcccttgcatgacatagagagatccttctttctttcctcgagctaccaccaagttacccttggttagcttccatcttccttcaccaaagtagtttaccataccggcttcatcgagcttacccgctgagataagattgagccgcatatcaggaacatgtctgacctcctttagaatcaatctacagcccatatcggttgtcattgtgacttctccaactcccactatcttgctggtaacctggttacccatcttcacgataccaaagtcgcctctttgatatgatgagaaaaactccttgtggggtgtgacatggaaagatgctcctgaatctacaatccatgaacagtcgtcatatgcaacattaagataattatcctcaccgattaagaaaacatcggcctcggctttggctgctacggctgtggtgttttgctcttccttcttcttcggatctatttggtccggcttcacggtgccatttttctgatctcttttgagcgttcgacattcgaacctcctatgacctggcttcccacaataatagcatgtccagtcagatcttgattttgaccgtcctcgagacttgtctcgatttcggtttttacttcttcctcgattctctgatctgccacgattctccgatctaccacgattctcgacgacatttgcctcgttctggctggtcatcccacgttcttttcttctggcctcttcattcaacaggctatctgcaactgaatccattgtcaactttccttctgaaaccgagttgctgagtgtcaccaccaaagtatcccagctctctggcaatgagctgagtagcaaaagtgcttgcaactcatcatcgatcttcatgtcaaccttagttaattgattgacgagtcctttgtatgtgttcaagtgctcgatcatgctttgcccgtccctgtagactaacttcacaagtcggcgcatgagagctgctttgttgcgtggggtcttcttctgaattaaagagtccaactttgtccacaactcataagcgtttgtgtaggttgatacgtgctcgaacagactcttgtcaatatacttgcgaatcatggcgaccgcctttcggttgagcagttcccaatctttgtcgctcttcccttctgtcttgtttgctgacaaaatcggctcatgtagctctttacaataaagatgatcttccatcatgggtttccaatacgtgtagttctctgcggtgagtttgaacatgtctccatcgagtgctgtaactccttccatttatgaacagtaccgtatgtataaacagtaccgtatgtgtgaacagtgtcgtacgtatgaatagtaccgtacgtatgaatagtatagccgtctaaatagtgatgaacagtatgaatagtgatgaacagtacttaccactatttaagccagctctgataccactgttgggtcggtaaccccatctttttgcaaaagcggaatgaacctgtgaggagatgggaaattatagaagcagaataatatcacccagagaacacaaaacaattttaacgtggaaaacctcctcaatgtgaagagtaaaaccacggggcactggcccagaaaatcttccactataaaagtaggattacaacaatgatctctctagtacagactagaggtttacaaacaaatttcttcaccctctaaggatggctcacacttaatttttatctctcacttggaggattacactctcactaaaatagtggatcactctattatttctgaggaactctctcttactctcagaattttcttctaatcggtttacacaccgatttctcttaatgctcccgatgcacttgatgcttctaaactgaatgcgtcgttcgctttatataggattgcaaaagatgcaacccatggactttaggctttcggtgcatgtgcaaaagttgctgctgaaactttcggtgcattaaaaaatcagaaaagtagcagccacttgctgctttcggttccttttggtgctggacaacaactgtgtgttgccttattttctaagcaatgggtcccacacgttttggaaaaaatgcctcccgtcaattgaggagaaacagccaacagaatttgatcccatttccgattgttcatcactggcttcagaatgcaagtttaaaatttgttatctataaccagagagataatagagtagaccgtaccgggaatttcgacgacaagtcagttgtgttctgctttgattatgtccaaagcttagtttttccgtattgaaattggtctcccctgcatttggttgtatgaatttatgttaaattatgtaagtggtttcagaatcttcccatttattgtatgaacatggaagaatttttagtttgattaatatgttggctattgctaatggtttcaaaatcttcccattcaagctacgatgctctagttaagtagttatacttggtggttgatcccctgcttatttgcattgaaccagtcagttattgctttggtaaagcatttcatggaaagtaagaagctagttgcatctatttagttgctgccaatgtacttaaggtataattagtactgatttacttataaaatatattgtgttcaagtcaaccgcatcagaaatgagtacataatcatgcagtttagaaaggaaaaagatgttgatagtttgtgtagtctttgactcttaaggtatgttcaacactgtgcaacactaaagggaaagaaagaaggcattttgagagaggggagcacctgttgttgtaattaatctactcatcctttgtttgttactttgtttactagtggataaggattattttcaaggatcttgcaatgatgatcaatagttgctagctagattcatttagtcggtgctgctaaattatagatgctaaagtcaatgatgtttagaaattagatcataggagacattttgtcagttttataagcaacaatgaaaattacatagtttaggcaaattggatttctctttaatggattggtgaagagaagaaaaattaactgctatgtaattaaataaatgtcttgatttgttcaaggaaaagcaactctttaaccaagtgaggaatgggaatttggagattgagtgatcattttaaaatctaagtgggctttggtgtccagtgttagagttaactggttaaccgatacatgtctgcataagttgactgaaacttgtaacaatttatgttgaattagcttcttgaataatcccgtgtgccaattaagtaatctttctgtcttgaaagaattgacacgattttctacagtgattatatgaacagtggactattagtaagttgaaatttgtatctatccatctatttgcttatagatataggattaatttaagtttaataaatgcactaataatttaagtttaatatagtgattcttaagataaatgggttgctgagagaataaggaatggcacgcatcaaaataaaaggactggatgatgttttgtttctatgattaggagatccttgggtgattagcatgtatgatattttggaaaataaatggagccaattttttaagttttggttagctaatagctatctttatttctttcaatgggtctcttaatgcataagtaactttacttatagtaaaatgaggtgggaaaactaaaaaaaagtagctttgtctaatttaagaaagcaagagaatagaaatgcttcctaattggatgggggacgaatggttgaatgattgtttagtgtcttatattgaaaaagatgtatttaaaagcattgataataagacaattataaaggaatttcaaaaaataagacttagaaggatgacattgtaattatttttctggatatatatttgaacttttgagtgttctccttgttttattttttggattcgccaaaatatatatatatatatatatatatatatatatatatatatatatatatattcttnnnnnnnntatactaaaactttcaccttgccaccacatttataatattctgtaacctgaaaaaaacatgaaagacaagacacatttaataatcccaacagacaaagacactatggatctgaatgcccagaatatttggtcatggtagtttagtaaaaggataaattatcttttcagtccatatattttttaataaaacttgatattagttgttctcaaattttagtcttaattaatttaattcttgaatttgaaaaaagacaataatttgttcctcctcagaataaaaataatgatgaaaccagtattatttttctaaggtttaaatattaatttgatgaaaataaaaatatggaaactaatagtaattaatatttatcgagagcaccgagattaaaaatatgccttgttaaggctagatcgacaccgaaagaggtttgggatttactaaatacacggatttcgtaatcttcatacacatataattaattttattttaattttattttgaatattgaattatttctcatactattactttcataataattttttttaatgtatatttaatacacatataagtttgcataataaattatgttaagaaaatataaacaaaggaattgtttgaaaaaaattatacattttttaataattatttccattatttttctaacctaagattattatttttattatataatatacttagttgattttgaatatgtaagcaccactaatcgcttctctataaaactaatctcgcatcaaactagtttgtttaaatttaaaataaatattttttaaatgagcacttatttaataaacaaaatacgttgatcaaaataagcacacaacttttttaagcataaacacaatttagacaaatacactaaaaaacagaaaattatttattttattaaaataaatatttttttcaacaaataaatttaagcatacttattaaagaacatcacttgatttacaagcaggatttgggctaattagctagtacacattaagacaattataaagtgattagaataattaactacccagtgtgggacttgcgtgtgcctaccatgaggtgaaccttatctaaggtggaacataaagaatattcttatggttttgaatctacttggaatactaataagaaagacgtgaaactaaaattccaaagtacaattaacttggtcctagctctagatagatccacatgcttacatgcctccgtccctaattggagatatatgaagtttatatttgatatggataagttctaggaaacaaagaatagtcgggactcaatctcaaaatttggaatatctataatttcttattaaaatgctgatctaaatggttcttaacaaaataacagtggttgtgacatatacttgctcccttcaccaaccacagggaaagaaggggcaaagctttgacttaggatatgcagttttcggaaaaggcattatagtctcagattaagtcggaaacactaagataggaaatgcacaatagtcttaaattcaaagacgaacttaattgtttcacaaacaaataacacagtgtggacactgccacactgtctataaatcaagatacaaaatctgaggagaaagttttaattagattttgccagtgtctataattatgtaataagttactagagttcggatggaagataaaatctagaccacaagtgtttgtcgaaaaagttaaattgaaagagaagaaacagaagtattgggaaaacccccattgaagccactgcatgagaaacccactcggaagtgtgttcaaatatcaaaaaggaggctgcagtgaaagccataaccatagcagcaacggagataataagtaaccaacgcccaaaagtcaagctgggatgtagtgatatcataaattctctttgtccgaaacttaatgaagttaaatttgacaagaatgagagtaaagacgcagaagaagtgaataatgtgactgtatttgtcaatatgaagacactaaaccacgcattggtcttatcactaggaatagtcagaccagccacaagtgctacggtagcaattgttgacacaagcatcccagattccggtactgtggtaacatgtggcttcactaactctggtataagttaaacgataaaatctagaccacaagtgtttgtcgaaaaagttaaattgaaagagaagaaacagaagtagttggaaaatccccattgaagccactgcataagaaacccacttgggagtgtgatcaaatatcaaaaaggagactgcagggaaaaacatctaatccccattgaagtgtgataaaaaaattgtaagatatttttgcacatgtggctcatgtgttgccaaacattaatttgtgttattagaataactcaacaaacatcgaataccattactaattcaggctgagtgctaataataaagctcacatccacatcatcatttcctgattttattgcatcaaacacgaggagcccaagagaaataacaaggtaatatatcaattacttctcagtagttagcttaaatttttcttgtgtgattaaaccttctccggagtaattattgtaaaaacaattaattgttctgaacatgttaataaacataaaaaacacattcagatcaaacagcggaagcagaaatagaaagataaatttcagaggtacctgttggattgagggggagcctaatgaatcaagtgaagtttcaaggatcaatggttctcaaggagaagattgttcaaagcttgaagttttggcttgtaaacatgatgttcaacttggctcaaacgaatgaagatcgaagctttgtgattcaatgtaaaggattgaattaccagtatgatccaaggttgattgcattgcattcacaattgattttaaacattgcatcattcaaatactaagtcattttatttggaaacttagaaaaagcctaaacaaattttgaaaaacaagtttgacgcgtattaatcgattactggacttttggaatcgattattttgttcatcatttttctggaaaacaaaatatgaacaatgtaatcgattacagctcggaataatcgattacatcaagctaaaacagatttcagaaattttgaacgactgttttaatcgattacaagaagtatgtaatcgattatatgcttgatcaaagagatcagcctctctggtttaatcgattaccaatacaagtaatcgattattttagttcaaccaggttttcatgctccctggtttaatcgattacggatcccatgtaatcgattatttggcccgttatgagatactctcaacggatgatttaatcgattacgacacggtttaatcgattacactagccgttatttgagttatttgaattccaacggtacaattaatcgattatttgagccgcgggagcgtatgtaatcgattatagttggtaaaaactgcctataaatagaactcattgcctttgctcgaacaactaacacattttaacatacaactcaaacttcacgagttctgagcatcatataggcactcctttgagttctcatcagccttgctttcattattttgttcatgaattattaaggtgatagtgaagcaagcttattcactcacaagtcattaggaaagctgatctgcattaatctggtttgcattcaacctgagttttcattcatattcatatcaatcttggatcatcaggtgaattctttcctaaactctttgtgggtgttgtaatttctgcagttatcttgttatctattgattctgttgtaatcagtttatcttacaagtggagataggttttctccaaagtacagctgagtggtgtgctcagtctgggttgctcctaaggatctaaaaggtgttttagatctctgaacttcttctagggttgaggaagaggagtttgtaagtacagctgagtggtgtgctcaggctgggttgctcctaaggatctaaaaggtgttttagatctctgaacttcttctaggtttgaggaagaggagtttgtaaggacaagctgagaaggggttctcagtttgggtagcttctaaggatctaaaaggtgttttagatctctgaacttcttctaggtgtgaagaagagaagttttgtaattgcttgtaagagaacatttacaatagtggaattctactcaggtgttgagtagaaaactggacgtagcctcataggttttgaggtgaaccagtataaatcttctgtgttgatttatattctacagatatccttaatttattgtgtgaactctgaactgaaccttgaggcataaacattcttggattgttactggttagagacattcaattttaaaaggcaatttagaactctgattttaaaactctgttttgtacaaagaaatttttaatttttccaagattaaccaattcaccccccctcttggttaattgtaagtgttccttattttccacagtacctacctccagccattgctaataaccttcaagtaatcttcggagttttagttttccagtctttcactcactcaaactcgatggtgtgttttctaaagagaggagtagacttggtgatctaaaacagagagtgcccagttctatttatagagttttgtccatcacagaactcaatctttaatggaataagataatgggttagtgggtgaacgtggccaataaatggaccacatacagaaacggtttccctaaaaggatatagactgaatatctaaatattcttatctttatggaataaaagatataaattgaatatctaaatattcatatcttttatttattcctatcattatgaaatatccttttagaaatataaaaccaacattctcccacttggtccatttaacccaacattagtcataagaagaaacaaaatatacgagtcatggcgataggtctcctaattaatagcgaatattatcttccatgtaccacaatatataaagtctctaaatgctagctctcaacttaatgaataaatcatatatttattccagatcaaaacttaatgatatttctcaaaaaataaataaatgaatatgtgcacaaaactctatgagaaaatatcaaactgaataagagtttcaaaattaacaattgattttttaataaaatcatatcatggaaccaagtcccattcgtactacatgatccttaaaattctttggtggcatgcctttagtcaaaggatcggcaatcatcaactcagtgctaatgtgttcaatgaccactttcttttctttaacacgttcccttatggttaagtacttaatgtcgatgtgtttatttcgacttccacttttgttattcttagccatgaaaaccgcagcagagttgtcacagtacatttttaatggcctagaaatagagtccataactctaagcccagacacgaaactcttcaaccatacaccatacgaggtagcctcaaaacatgaaacaaactcagcctccatagtagaagtggcagtcaaggtctgcttggcacttccccaagatacagctccaccagctaacataaagatataaccagatgttgattttcgtgaatcaacgcagccagcatagtctgaatctgagtagccaatcacttccagacaatctgtctgtctgtacatgagcatgtaatcttttgttccttgaagatatctcatcactttctttgcagctttccagtggtcaatgcctggattgctttgatatcttcccaaaactccaacagcatatgcaatgtcaggtctggtacaaacctgagcgtacataagacttccaacaattgaagcatatggaatattcttcatgtgttcccgctcaaaatcatttttcgggcactgactcaaattgagtttatcacccttcataatgggagctacacttggtgaacaatctttcatgttaaacctctctaaaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagacaaacccaaaatgcctcgagatctttccctatggatcttaatgccaatgacataagatgcttcacccatattcttcatatcaaagttctttgagagaaattgtttcacctcatataataaatccttatcattagttgcaagtaaaatgtcatccacgtataacacaagaaagcaagtcttactcccactgaccttttggtatatacattgatccatgatgttctcttcaaaaccaaatgaagtgatgacctcatggaatttcagataccattggcgggacgcttgtttcaatccatagatggatttattaagcttgcaaactaagtgctctttatcactagaggagaatccttcaggttgtttcatgtaaacctcttcctctaaatgaccattaaggaatgttgttttcacatccatttgatgtaactcaaaatcaaaatgagctaccaatgccataattactcgaaaagaatctttcttagatacaggagaaaaagtctccttgtagtcaattccttctctttgagtgaaacctttggcaacaagtcttgccttatgtctctcaacgttgccttgtgagtctttctttgttttaaaaacccatctacatccaatggcttttacaccatttggcaactcaacaagatcccagacttgattagatgtcatggaatccatctcatctttcatagcattgtaccataagtttgattccttagaactcatgacctgtgaaaatgattcaggatcatttgcggctccaatgctgtaatctgattcttgcagatacaccacataatcactaggaattgctgaccttttgactctagtagaccttcttaatattgcttcattatcttcttgaggaacttgttgttcctcattagcaacttgatctatagggtcattttcaacagtttgtggattttcaattactggttgtctaacacccgtttgagcttgaggggtgtgcctgacaatcaatctttcacctaagccagagggttgggcttcatagtgatccttttcaggagtaatatcctgaaattgaccactcccactgatcaagtcattctcaagaaattttgcatttcttgattccacaatcctggtgctatgtgatggacaatagaatctataccctttagaccttttggcatatccaatgaaatacccactaatagtccttgggtctagtttcctttcttgtggattataaattcttacttcagacgggcatccccaaacatgcatatgtcgcaaactcggtttccaacctttgaataactcaaaaggcgtcttggagacagccttggttggaactcggtttaatatatacactgccgtctttaatgcttcaatccacaatgacttaggatgcttggaactactaagcatacttcgtaccatgtctattaatgttcggtttcttctttctgctacaccattctgatccggagaaacagacatagtgtattgggcaacaatcccatgttcttgaagaaacttcgcaaatagaccaggtgcttgtccattttccgtgtatctaccatagtattcaccacctctatcggatctcacgattttaatttgctttccacattgtttctctacttcggccttgaaaactttaaaggcatctaaagcttcatttttagaatgaagcaagtagagatacatatatcgtgaaaaatcgtcaatgaaaatgataaaatatttcggattacttgcttccatatctggacaacaaatatctgtatgtatgatttctaatagatttgagctcctctttgcacctttcttagacttgttagtttgcttacccttaatgcaatctatacaagtatcaaaatcagcaaaatccaaagtactaagtaccccttcatttactaatctcttaattctctcgatagagatgtgtcctaatcttcggtgccacaacatagaggattcctcattcataacacatcgttttaacccgacagaaacatgcatagaattataagcagcattattttccaattcaataaagtaaagtccatcaagtaatgtaccggaaccaataattccagatttattcattaaagtaaaaccagaattcgaaaaattaaaggaaaaacccaatggtgcaagtcttgatacagaaattaagttcttagaaaaacttggaacataaaatatcttgtctaaatgaaaaataaatccgttgcttaaaactaaattgcatgtcccaatggcttccacatgtgagctcatcttgtctcctgaatagatgtactgctcacttcccactggcttccttaggttttccataccctgcaaggtattggaaacatggattgtagaaccagaatcaatccaccatgtgttatgattaacattaaccatattagattcataacaaacaaaagttaatggagtacctttcttgtcaaaccagctcttaaactttgagcagtctttcttcatgtgtcccttcttcttacagaagaaacactttgactctttcttaatgactggctgagcaggaatcttgcccttattcttggcttgatcccctttcttctttccttgagtagtcatgtataccttttcaccctcttccattatcaacctttcttcttcttgaacacacatagtcaataattcattaattgaccacttatctttatgtgtgttataggagattttgaaaggggcatactgaataggtaaagtacataaaatgtagtgtactaggaaagaatctgacatggtaacttccaaatttctcagttgagccactatatccctcatgcgcatgatgtgatcacgcactctgtaacatcctaatatttttacctattgtttatggattggaagtaatattttaggactagtagaaaattaaaattcactagttttaagatttttagactttactatatgtgggaataaaatttaatctaagttattttaagtactagaaaattataggaaaatgatgaacataatcctaggagttttcgtataattatgggctaaatagatttatttcttaagatagtttggtattttacaaattaaaacaactaggaacaagattgttattacttcatgtagaatgaaatagcttatggcctaggaacaaggtgggccgtatgaattaagatggataagatttttttttaattaaccatgtgcatatgaattaaataaacaaattttagtggaaccaaaagatgcttgcacggccaagaggaaggaaaagaaaagcaaaacagcctagaatgagaaggccacgtgaagtcaagatggaggaagccaatcatgtgtaaagtggaagtataatggaagacaagccattggtggagagataagataagtaatatgattacgttagtggaaatgttagtgggaataaagaattagaattatcaactaaagctttccttgagttggctatataaggaagcttgctatgttgagtgaatgaagcattttaggacagccatagagagagcaaccgtgcagcccctattcctttccatctagctttgtttcaagctttgttgaattccaaacataagccaccatccatacccttcatacatcttttcttgatatcattttcaccaaagaaaaacacctcaagaggccaaggaaattcaagtgaagaaggatcaagggagcaagcttgttcaagttttagaaataattaaggtatggggaagttgtgataaattaaatttaaatatgaaacctttacttaaaattgctacctaaatatttgagttgataatttgggataatggataaagaattgagatttgagaatggaaatttaagatgaataatctcaatttaattctaagtaatttataaaactttaatttgatgtctaaaggattagaattatgtttatgatttattttggttatagatagtatatatgttccttaatgaagtttatcttttaatgtttcttacttatttttctaaccatacattttgttgtttctatattcgtttaaatttttatgttttgttgtttaagtattttctcatgattgagataatcttctaattagtcattttgtttagtgtacttgaatcttgaaaactcttgtgatctatttatttgtattgatgataaacttaaaacatgtggaagtctaatgtctcttaagatttaatttatattttatgaattattttgattatggacaatatttatatgatgtggttaactatggactatgctaatttgattaataataaaagactttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctgttgatatttaaattttgtttatcatgactaaccctgtgttgtgtctggtggttgacacatgtgatgaccccaaattatttgggcgagcagaacagcagtgacatggatgctgtacgtgaagatatgatgaagtgtgtgtgatgctgatatgatgaagtgtgtgtgatgcttatctgcttttgatgatctgtaccttgttttgtgcattggactatttatatagttatggacatgtaatacctgactgtatggtatgtatgtgtgaacgttatggactacacacgtcaaataacgcgtatatttcttatcatttctaaactcattttatcaacgtgaaattttcatttgaaccttcattctttctgtttttttcgaaaaaaaaaaatctgttgcaaataaaataaatacgaaatagaagctgtggttacacactccttttatcccatttagctttaaggatgaaaattgcattataagggtgctggcaagggccttatcagatgtaacaaattgattatcaatggccttcaaaagatccttgaccttttcatgctgatcaacagaactacggatactagcagatatataagtctttatgaacattacagagagacgattagatttctcccatttttcataaagattaatagcatcttgagtgctagtttcattaatacccggtggttcagttttcctaatagcatagtcaatatccatccagcctaaatgaagaagaattctctccctccaaaccttataattgtcccctcttaattcaggaattttacacttaatatcagaaatatttccagattgattaactgaaattcaaacatacatttttcagtattcataatttgagactaaataaatataatgtttttaccaatgtaaaacatgtattatgaacctagtgacataaaacttgcctgtgggctaaagtcctactcaaattagattcaaacttatgataaaactatcaaattataataattattcttcttaattcctgtgggtaaattaagaaatataacttgatattttatcctaattaatcatacaaatataataaaattcctgtgggtagattttattacattacgtataattaatcacaattaatgttttaaatgtgattttaacacttaatatataagtttaatcaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccttaataatgcaaataaattgaaataacattagatatagttattcaataagctcattaattaatgtgaataaattatttaacataatattgtatatttaaacaaatatcataaacatacaatttaaataatttaaacacataactcataacccaaacaatttattacataaataaatcaattatgagcaatatttgaattaataattaattatattattaattcaaatacattaaaacattttataaaatgcacgtatataaaatgtaaatatcaacgtgcacgtaagctttcaaaaggaagcaattttgtaattaggctttgttttaaacataaaggctattaagcttcttaagtataaataaaaggaacttcaaaaaaaatttgaacagcaacgtgccagctataagccttttaggaattaaccaccataaacaagcccaccataaagataagaaaaaataaaccacggaaaggaaacagaaactccgaaagaaaattagacgcggggcaagcattaatgaagtgaaaaaacatcatcttcaatcaccgtaaacccgcataaaaatccaatagtttattttaaatactgaaatttatattttaattcacataaagcttagaaatttaatttctatataatttcaaggcttcttaataattaaaacgttcgaataaaatactcatatttcaataaaacaatatttaaaaaatatgagtgtcaaaacaaaagcaaagcataggcaaaaccaggctctgataccaaatgtaaaaacaattaattgttctgaacatgttaataaacataaaaaatacattcagatcaaacagcggaagcagaaatagaaagataaatttcagaggtacctacctccagccattgctaataaccttcaagtaatcttcggagttttagttttccagtccttcactcactcaaactcgatggtgtgttttctaaagagaggagtaggcttggtgatctaaaacagagagtgcccagttctatttatagagttctgtccatcacagaactcaatctttaatggaataagataatgggttagtgggtgaacgtgaccaataaatggaccacatacaaaaacagtttccctaaaaggatatagactgaatatctaaatattcttatctttatggaataaaagatataaattgaatatctaaatattcatatcttttatttattcctatcattatgaaatatccttttagaaatataaaaccaacaattatctcttgtctatgcagactgtgaagcttttgctggttacaaaagaatttacttcagtcattcgggaaattcacaagttgcgtcactgacgtgcgaatacaagtacatttaatagtctgtaatacaaagaaccaaaactatctggttttgttaaaacttttggtgaaaactgttgttgtaattgagcaaactattcactatagaatcagcactagcacataatgtggaaattctagctgagagatgcaacattctaaagaaccttgcagcagcttgatgttaaatattatatgaacaatgaatttttttttttttcatgatttgcacagagcctggacattgcagtggcagaggaagggggtatcgatgtcagaagagaagcatgaggaataccctgaatggtccttgtctgatatggaaaaaatgaacattgatcccatgcagctagctgattaacttaaatggaaggattgatcgatgaagaggattatgatgaagaaatgtagatgaacctgttttggtttagaaagttctaattgagaattagagtagaatgtttaggagtagtattgcacaaatccttagtggttaggacgattaggaggcacaggacattgaaaactttagtccttacaacctttgttttaggataaaagtggagatatagattgttccaattagaaatagccaaagtattgttatttgagaaattttaatctcatataggtcttgcctatggtaggcgctacattcagatccttaaacttacggattttgattttgtttggattgttagctttgattgtggcgttgtgtatgtaagtctgttattgtatcacatgacgtttcctatcgagtacaatttgagagagcaaatctgcggagcaaactcactgatccggcgacttaataatgatttgcacttggaccttttttgttatcttgaatttgatgagaaatcagataaatggaaaagaaataagggggatagaaataaaagtttaatatctatgtataaaacagttttaggattttacaaattatcattccatcacaaattattattttaaaagtcaacaaatttattatacatagaattgtgattgaatgattatataaattttttttatatctcaatgcataactcttttctagaaataaacacaaaataagatgaaaaagatgtattatatagatgaatagaaataacaaaaaaaaatgtaaatttttatttgtttaaataaataagagagtagaaaacaaaaatatggtcattgcaaaaatgttcatagaaataaaaaatcaaatttaatttgaaaatcctgaactttttatttcattatttatcaacataaaaatattgttataaaacaataatttgattttttaaatttaaacataagtaaaagaactctgctaacaatttctccctccatttcacgtctcttaatgagaaatatggtttggttatgacttattaattataatttcatttctcattttctaacactttcaatcaagaatattttttttattacttatttctcttcattttaattttatacttattataattttgttgtatataataattccttttaaattgattaagattaagtctcaatgaaagatgaatttataacaaaaaaaactttttatgtgatatgatttgctcccttcaccaatccacatggaaggaaggggaaaagctttgacgtgggttatgcagcatagtctcaaattaaggcgggaacaataagaaaggtaatatttcatgagatagaaaatgtagaataatctcaaatttaaacacaagctttattgttccacaaacaaataataatacagtgccttaaagttatgccaatgtctgtaattctgtaataagttagctagtcctgtttggacaaacgataaaatctagaccacaagtgtttgtcgaaaaagttaaattgaaagagaagaaacagaagtattgggaaaagccccattgaagccactgcataggaaacccacttggaagtgtgatcaaatatcaaaaaggaggctgcagtgaaagccacaaccatagcagcaacggagataataagtaaccatcgcccaaaagtcaagctgggatgtagtgatatcacaaattcgctttgtgcgaatcttgatgaagtgaaatttgacaagaatgagagtaaagacgcagaagaagtgaataatgcgactgcatttgtcaatatgaagacagtaaaccagacattggtcttatcacctggaacagtcagagcagccgcaaatgctacggtagcaacaagtgttgacacaagcatgccagattcggctattcctttggctgtttccttaatttcttcggataacttcttgtgttcatcataaaatacatcaattggcgtcttgcccattttgtttctcattgctcttagttcacgaggaacattcgactccacgaactatttacaaatcaagagtatatgtaaatgatggtatccaattgcataacttaattaatctttcaattgtcacttaattaataactagagcaaattccagcaatacctcctaaaatttagtgtaattacacaaatatatatatatatatatatatatattctcagttataagcttaaaatttgaagaaatgttagtgtaatattttgaaacatataagaaatgttggtgtaatttttcaaacttaaaaggagttagtataagaaaattaaaaaaaaatggaattacatataactacacgaaactggagaacaattattgtaatttgctctaataactattagatattaaatttgtaagaaatacaatttcaaagttaagatattttaaaaataaatcttacgggtgatatttattgttacaaatgcacgtgtataatttttaattaaaattttctatccatatattggctgtttaactattatgctaaagacaatggataacaaattttaaaaattattacaataatcaataaatactacatacaatgatttctatttttaattaatacttgttacttttaaagatttaaaatcagtctagttaataaaagcctaaaatttgtggaattttaaaaattttaaaataagattgctagaaccgatggatcccatgcgagtgaataaaaatggttgaataagaaaaactaagcaaattaattgaccttgaaccatcggagctccctttgcattttaaagcttgctcttaaactggacaaatcttcgaattcaactgctggaagatgcgcagccaagtgtagaatgttgttactttcattgtccacttctcgtactatatgctctactaatttccatagtatcatattaaatattctttttcgtcgaaatagcacaaccaagtgcagtaggttccgtccattttcggggtcctttattctcactaattcaggctgagtgctaataataaagctcacatccacatcagcatttcctgattttattgcatcaaacagcactgacgaaggattagttatcccgtctatcatccgcttatgttccaattggttaacttgactccataagtcttcaaatagccaacgaccttgtggtctctcgccctccatgtctagtaagaggtatatatatagttgattggtccaaccaatatttaacatgaaatgaaacaaacaaaacttaaatttaaattttattcttatatataagaagcaccattttttatctctatttaaaaaattatatattttaatccgtacatgaaaaaaaattgtaagatatttttgcacatgtggctcatgtgttgccaaacattaatttgtgttattagaataactcaataaacatctaataccattattacactggatatagatatttaaggactaattcttaattttttttatataaaacaattatatataactttctaaaataagaatcaaaatggaaattaatgatgtcaaataagacctaaattttagcttagcgcgcacacacaaaaataaaaagccattttcaacatgtgaaagcttacctaatttttttggaggctttcgcgccagcatatgcaatgctgtaaggttctctttatttcttgcaatggccagagtagttggatgttttccaaataatcgcattgccaaatctgttatatgcacaaattaagtaaaactccaactaaattgaaaaaccacgtacttagttcatatgtatctccttttatatatctgttatatgcacaaattaagtaaaactctaaccaaatctgtctcgacttattgctacatgaaaagctgtgtctccacttgagttttgtattagcatgtcttctggcctcatacggttatccaactctctcacaatatcacggctggcccaacgtactgctacatgaagagctgtgtctccacttgagttttgtattaacatgtcttctgccctcatacgcttaaccaactcttccactttttcaagactgccttcacttgctgctacatgaagagctgtgtctccatctgagtttggtattagcatgtcttctggcctcatacggttaaccaactctttcacaatttcatggctggcccaacgtactgctacatgaagagctgtgtctcctctagcatttaacggaaagcgtaccgtatcaggacatttatcaataatcgattttgattcgagccacctattatccaatatatgttggtacagatcatttaaagaacctgcaatcgtttcaaacttcacattataacatgtcctttatatattaaccataactttttgtatttagttgcaaagaagacccttttaatttctcgtttaccttaaatctgtaaaaattctcttggaaacttgtctcaaattttgaattcttaataatttcatcatttgtaatttgaaatctacctgagaaatttgagattatgtagtagtcgaagggatccaatcaccaatcacctttaattaagtttgaaaattaattctatgatgataagtaaaattgtttttgagagaagtaatttattttttattttcttcagttgacaaaagctaattgatcttaacatgtgacttatttatactcactttaaaagtgattctactttttttatctttccaataaaaaataattttctaaacccattgttgaaatatcattcgtataataatagtataaatatatttttcttaacgtcaggggtttcaaattcaattttttctaaatgtaaaaaataaacaaactcttaattaagacatgatctctgaaatacaccctactgtgaatgcaatagtttaaagtataacttactcagctcttctggagtcatttcattcagtcctctagtttcatgttttggtgccggcgagtttgttgaagtggcaattggagtttgctcatgactttgattaatctgaattatgtggtcatctgaaacttcgctattggagttcatgatttaattctagggaaagtgaagtgatttggagacctctctgaaattccctgttctacaagtgttgcttctttctttccagcctgcaagcttgaacatattatatatggtggtaaaacaagagcccttaattagttttccaacttacacttaaaataattattcccaatatgacattttgtggattacagcaatgttcaatcttttcaacaccgcaaccctacagttttcaaaagctttttaacttgaatgatttctaaatttataatattaattcttttttaaagtaaataaatatattcattaaatttgttaacagaaaacaatatatccattataaaaaaattatattcattaaattgttgggattagccagactcaggtatcatgaccctgttaattaacttactctcaatttaatattatctttcattgttggacaatgatatgatatctttacacacataaaaagtaaactacacaaactatccctaaagttttgtgaaattatataaactacacctaaaaattatattcattaaattgtggggattagcgagactcgctatcatgacactatgttaattaacttactctcaatttaaaattatctttcttcgttgtacaatgatatgatatctttacgtacacacctaaaaccttcaatttccaactcatattgttgacgaaaactttctgccatggcggtgattatatatttatccaacttccgttgacgcatttaattatatgattatatcctaactctggtctttttatactagttataatcaattactccaacaaccattgaactcacagctaagaccagatgcattttattatcggaatatgtataaatttatttaactcactccaacaaccattgaattcaaagcaagactaaaagatagttacccacattttgattgttacgttggtaattgttgttatgatatttttttatgtatgttttttattttattaatgataacatacaaaaggtaacggattgatgatatataataggagtatgatttggggttggtataaactgaattatgtggtcatctgaaacttcgatattggagttcatgatttaattttatggaaaatgaagtgaattggatatctatatgaaattccctgttcgatcagtgttgcttctttctttccagcctgcgaagattgaacatattatacatggttgtaaaacaatagcccttaattagttttccaacttacacttaaaataactattcccaatatgatattttgtggattacagcaatgttcaatcttttcaacacctcaaccctaaagttttcaaaagctttttaagttgaatgatttctaattttataatattaattcttttttaaagtgaataaatatattcattaaatttgttaacagaaaaaaaattcattaaattgtgtgcattagcgagattcgctatcatgacactgttaattaatttactcatatgatagtggtggttatatttttattatatattttcgttgacgcatttaattatatgattatttatctaacacatttttataaagtttaggaagacacatgctacaatgggagagtgtaattactctcaatttaatattatttttcttctttgtatgatataatatctaaatatttttaatgttacatattgaatttaagatctgatatttattaaatctttcaataaatgaggtgaacaaatttccaatatggaatataagtttttggaaaagaacctttaatatctgcaccgtgttaaaaaagaaaagttttttttcatctctctcccctaatatctcaaaatgagatctaccactaaagaaaaaaatgtaagagatattgaaagatttttaatcttatgtggtactatggagtctaccagaaagtggtctaagatcccaatttggaatcttacactaaagatgagcaatatattgagcttaagatctgattttcactagattttccaataaaggaggttaacagaactccaacatgaaaaatgaatttttgtaaaaaaaaaatccttaagatctacacaaagttcaaaaaaaaatttcccctctctcacactaatatttcaacatgagatttatcactaaaaaaaatagaagagatcttcaatcttacttaacattatatagtctactaagaagtggtctaagattccaatttgggatctaccactaaaaatgtaagcatctttagtggtagatcttatgcaaggatcttaaactcaagatctaatcttcactagatcttctaataaaaaaggtgaacaaatctctaagtaggaataatgagttcttgtagaagaaccttgaatatctgcataatatttaaaaaaaataattttttatcatcttttttctcctaagattttaaaatgagatctattaagaaaaaaatgaagagatcttcataaatatttaatcatatgtgatactatgggtctaccaaaaagcgacctaagagcatatttagtggtagatcctaaattgtgatctttagaccactttttagtagatcccatagtctcataatacgtaggattaaagatctcttatattttttattctttttttaatattgtgcatattttaagattcttttataataattcattatttatattgaagatctgtttacccctttattagaagagctagtaaaggtcagattttgaactcaaaattcttattcatgatatcttaattaaaaatctactattaaaatgcttattattgtcgaaaattttctgccatagctgtggttatatatttatctaccttccgttgtcgcatttaattcttggattatatcctaagtctggtctttttatactagttatagtcaattatgccaacaaccattgaattacaagatgcattttattaattttattaaacccactacaacaaccattgaattcaacgcaagactagaaaaaaaatacttatttaatattttggtaaaatttattcagccaatcatattaatagttatttttgacattttaatccttttatgttacgtaatataaattcttttattaataatactaaacaaaaattaataaataaataaatttgtcacatttttttcttttaataatttaaattttcttatttaaaaaataaatttattaatgatctatatatttaaaaacaaaaataattatttattctaacatattttataatgtttagaaacacgtaggctatgatggaagaggataaacggtttctcatcttaagaaagtattttatgaccatcagattatttattttaaaaatcaatgatagtaaatttttcttcttttattaattttttttcttttttttgtcctctttcccatactacccttttcctctttcttcttctcttctttcccattcttcctctcttcgtcttagcggcaacagtgatgccatgacggccgatgatagtggggatgttaatgcgtcgttgcttggtcgttgtgcggagtaaactagagagtgtctttcgccgtttttcttgcggtgttctgcaacaagatttcaaccggagaaaaagcatggaagacgaaacagtcacaaagctttatataactattgcctcacttaaacccaaattggattcaattgaccagattttagtctcccaaagttttgagctttttgatatttattgtgtacgtgttgattttttctcatgggtgccaagttacgagtttgtttcttgcataaacgttgtttctataccattttactcgcaattttgagtcccatttgggagaataaaagacctaagattttggttttgaaaatcagattacattttttatgacgatttgtgattatatttgaaattgcagtttcaaggaaattattgtaccattgatctgtaatatttgtaatctggccttgttttctatgttcagatatgtgatgggtggtggtggctcagccgccgcatctgtggatgtggaatagggaaaaaggaggaaagggaggggttgccgaaaattgctttctgcgtaggtgtcgttgtcggatacaagaaaaatggaagaaaaggaataaatcggcaatggtgatgaataagcaaagggataaatcgggaagtcaagaagaaaaggaaaaaattataaagaaaaaaactcatctatgggattaaaatttaataaatctaatggtggaaattcactttccattgtggaagacctattatattctcccacactagtggattaaattgtacattatgaaacatttaatactaaaaataatattcaacgaaattatagagtctaaatgtatattttattcaaaatatttcaaatcttgctttgaattagttgttgacacttgacaccttgtttcatactaaattatgcaagatgtaactatatatataggatttaggatttaaatcatggataataagaaccctaaatcctaaattataaaccacatggaaagaaaaagactttgacatggtgtatgtgtagtttacggaaaagataatatggattaattatagtatgtttgaattttggctttaaaattatcatgaaatatggtgagataagtcaaatttaattttatctaaaactagataaatggctcatgactccacctgtagtaattttacaatttataattttttataatattataattttttatgtatttaattattatattttaattaataaaatatattattattaatatgttagtatttaagttaacatttttttattatcattataataaattataatggtcgaaattcatgggattaaaatttgataaatctaatggtgaaaattcactttatcattagtgggagacctattacgctctcccacgctagtctctgtcagattagggattgaattgtacattatgaaagatttaagactaaaaataatattcaatgaaagtacagagtctaaacatatattttacccaaaaatatttcaaatcttgctttgaattagtatttgacatttaacaccgtgtttcatactaaattatcccacatgcaagaggtaactatatatataagatttaggatttaggatttaaatcaaggctaataagaaccctaaatcctaaattataaaccacatggaaagaaaaagactttaacatggtgtatgtgtagtttatggaaaagataatatggattaattatagtgtgtttggattttggctttatgaatgaacataagatgagtcaaagttgattttatctaaaactagttaaatggttcataacttacaccacaataattttacaatttataatttttttataatattataactttttaagataacatttttattattattatcattataataaatatttatgacaatttaataaaaccatgataataaaaaaattaccataattattacaaaaacatattagtgctaattaaattataatccatattatctcatgcatcaattattttttgactacaaaaatatccctaattaaataagagaaaaatcatattaacatatatatttagaagagagagcaacattaatgataatagtatttttgaaaacatattattttagaacaaatttataattatcaacttaattaattatttttttaatcttgataaattagataattgagnnnnnnnnnnttttatactagttatagtcaactatgccaacaaccattgaattacaagatgcattttattatcggaaaatgtatgaattttattaaacccactaaaacaaccattgaattcaaggcaagactagaaaaaaaatacttatttaatattttggtgaaatttattcagccagtcatattaatatatagttatttttgataatttaatccttttatgttgcataatataaattcttttattaataataataaacaaaaattaacaaataaataaatttgtcacatttttttctttcaataatttaaattttcttatttaaaaataaatttatcaatgaaaaataaaaataattatttattctaacatatttataatgtttagaaacatgtaggctacgatggaagaggataaacggtctctcatcttaagaaagtattttatgaccatcagattattttgtttaaaaatcaatgatcgtaaattttttttcttttattaatttttttcttttttttgtcctctttcccgtactacctttttcctctttcttcttatcttctttcccattcttcctctcttcgtcttagcggcaacgtggtgccatgacagccggtgatagtggggatgttaatgcgtcgttgcctggtcgttgtgcggaataaactagagagaactcgagagtgtctttcgccgtttttcttgctgtgttctgcaacaagatttcaaccggagaaaaagaggtaatataatatagtagatagtagattttgcatgtttagttattttagcataatcaattttaattgaaaaaaattatatatgatggagttgaagtaggaataacttctacttctaccaaaataaatcgtagttaattatattttgtttaatttactttcacataaatactctcatatgcatatgtttgtttttatttatttgtttaaaaacataattaaaattcttgctatatttatagattctagttgttatattttttttttattgaatgcattttatctaatttatccttgtactcataaccataatattgtgataaatcattttaaaaaaatgaaatattatatttcagtttaattattggtacatttgggtttaattctatatatatatatatatatatatatatatatatatatatatatgaaaataactaattgttatagaaaatcagtgtatatagacattcaaattcattttgatcattacaccatcaaaatcaatttaatacaaacctatagtgcaaatcaattctaaccataattatgtaaaatcattttggtgcaaatcgacattgattagtttttcatctccttcaatcatcttcttgccttaacttgaaccatctacctatagtgctcttaatttcttacaaatctccaatttctccgcgctaccatgaagttgttggagagcaacaacaaacaagtgtcaattacaaacattggcaaaccgcaaacctatacaaaagcagaaaaagaactgaacaaaaacatttttcttgaatgaatcaacagcttaatattacaagatctcaaattaaatatccatccaagagcttattttgaaacttttatacattatgacgcccgagtaaatccataaaattaagcttttcacaaccattaaatccattcacaaatcatggctacatctttgaaaattggattacctgttttttcaattgtatgtgcctgtttgctcttctattttctccatatagactacgaatgttacagtagaacatgagtagccatatagagaaaaataaatgcaaactaactaaatgataggataaaacaaaacaagagatatcaaatttaaggtattgtgtttgtttgaggaagatattcgcacatgaggttgaaaccagtattagaaaaaccatcttcaaattggacaattcaactactgaactgctcaaataacatgtctgaatgtctcatcagtaggctactggatcgatttgcaattggttagtagactatcttttagtttctctctgatccaaaactcttttttagcttagcgaaacttgaaactaattcttttaaactaattttggtttagtttggttcagaggaacaatttggtgcaatctctctgctttcgattcaaagcccaagtatagaatcaaagcccaaagcccaagtatatgcacttgtgtgaattttccatgcctttctttaatttgctgacataaggggattagagcttatcattagcaaaaaagggtttatcgtccgaggaattgaagtttagctaaataagagaaattgaatcacataattaagacgaccaagagattatcttagggtggaatcaagggaatttcaacacctaactatttttattaattgatttttctagtacattcaattgtgctaatgtttctttcaatcaaattaaaaaaagtctaaaaattcctaattgtttatctcttaaatcaaaagagtaatcgataatttgattgattgtatatttgataaaccaaatttttcattgatacaataatttgtccttattttatcaattgtacaactagtacacttttcgtattctaaccaaactccaacaatatactggtaaaaggtgactcagttgatctttaagtcaatttaatttccatataactaaacgtgatgggaataaagtacgtagaaccgtagaaatatagatgacacaatttgtttgatgttaattaatgtaaatatactttctcttgatattcaataaatatgcatgttgtcatcgtaaaaaataaaaagataagctattttttagtttctaaattttttaaatttatctttttagtctttgaattttttatttatatttttaatctcttattaaattggatgatgcattcctgtgtttatcactttattcgatctaaattcccctatggatattaatgaaaaaagaggtccttgactgcttgggcaagtcctcgcgagggaactttatttgttgaagtatgtatttcatttttgtgcttttgggagtttctataaattatctctgattaataactatttatgtttatgtattgcagctaaagcactagagctatttctgcaagatttgtgtgatcgaacatatgagataactttgagggggggacaaagactatgaatgcttttcatttgtaagtgaagtatatattattttcttggttcaaatttgtgtctatgtcaagtctgttcaaggtggttaccaggctgcaggtttctttcttttggagggcggttattactatgtacttataagaacatcagatctgcaattctaatgataatgtgctcagtctcaaacaatttccctcttgtaccttctatttatcgcatgcacaaacatgattagacatgtaaatgacatctgcagaagcaaatgttgggatggtcttgcttttggaacatgtgctgtttgttctagtatttaccttcactttccagtttctaaaatgtcccgagttacttgcgtccttgcctttgcagaaaacagtgtgtgcagacttttaatatctttgattttctgaaagatattgtcagcaaagttcctgatttaggctgttctgtttcaactggtgatgaccattctgtcactaagaggaggtttgtgctctggttaatactcttgttacttggaacaagttttcagtatgctgaactttgtttactttatattaggaaagttgccggagatgatgaaaatgaaagcgacgaggagctcaagagaaaaaagaaggtaatttatcaactgtattcaattacttcaacagtggttaccttaaatttttcctgtgtgattaaaccttttgctgagtaattatctcttctccatgcacactgtgaactttttgctggatacaaaaaaatttacttcagtcaatagggaaactcactagtggcttgtgaatgcacgtttgtctaaatgtctaatagtctgtgaggctaggccacacttcaacttaaagcttactacacaaagtgccaaaactgtctggttttctgaatactttggctgaaaactatagaattggcactaaagaacttggcagctgtttaattttaaatattatctgacttatggaactttttcttttcatgatttgcacagccagagcctggacataacagtggcagaggaaggggtaggggcagaggtaggggatgtggccgtggaattagaactgtagatcaaaagatgagttcacatgccaagtgtgaagatgattctgatgtattgaagcagaatgacaaccacactcaaagcaatgaaagcatggaaaatgtgccggaacctgaagaagttaagcagagttttccagtaagcaaaccggctgaagtgtccattcgaaattttgacttaaatttgaacccagatgaggatatggattcattagacacaccaacttctgtcccaactagttcatctgcaaaatcagtgtcagaagagaagcatgaggaataccctggatggtccttgtctgaaatggaaaaaatgaccattgatcccattcaactagccaacataaatggaaggattgatgaagatgaagaggattatgatgaagaaatttagatgaacctgtgttagtttattcattacttctcatataggccggtcattagaatgttcttatggggaattagtgtagattttgtaggagcagtgttagatagatacttactccttagtagtttaggaagattaggagggatagggcattgaatactctccttataacccttgttttaggttaaaagtggagatatagattgttccaattagaaatagccatttgccagtataattatgacttatgagaaattttaatctcatgtaggtattgcttatggaggcactacattaagattttgggtgtgatatggctcaaaattttacggggatgcctatcttaatcacacttgtatctagcggaactaactcactgctccagcaacatgatttgcatgcaaccttttgaatttttgctatcttgaacttattgcacgatcagacgaggaaaagaataagacgttagacggatagaaataaatacgaaataaagtaaaaaagatttgttatttagatgaataaaaatagaaaggaaataagtgtagaaattcattatttatgtttgttttggacaatgaaagagaaaatacaaacagatgaattttttgaaaaaattatacattttttaaaaattatttccattatttttctaataagataatttttttattatataatatacttatttgatttttaatatatataagcaccactaatcgcttctttgtaaaaccaatcttgtgtgattaaaccttttgctgataatgacagcgatgaggagctcaagagaaaaaagaaggtaatttatcaactgtattcaattacttcatcagtggtcagcttaaatttttcttgtgtgattaaaccttttgctgagtaattatctcttgttcatgcacactgtgaaccttttgctggatacaaaaaattttacttcagtcaatagggaaactcgctagtggcttgtgaatgcaagtacgtctaaatgtctaatagtctgtgcggctaggccccacttcaccttaaagctactacacaaaggaccaaaactgtctggttttctgaaaagtgaaaactatacaattggcactaacgaaccttgcagctgtttaatattaaatattatctgaattatggaactttttttttccatgatttgcacagccagagcctggacataacagtggcagaggaaggggtaggggcagaggtaggggtaggggccgtggaattagaactgtacatcaagaggtgagttcacatgccaagtgggaagatgattctgatgaattgaagcagaatgacaaccacactcaaagcaataaaaacatggaaaatgtgccagaacctgaagtagttaagcaaagttttccggtgagcaaaccggctgaagtgtccattcgaaattttgacttaaatttggacccagatgaggacatgtagattgttccaatcaatattgttaaaacgtagtgtgaacgtagaaacggtgagggtgaacaaaaacataaaaacgtaaaatgtaaacaaaacgtaagagtttactacatacacaaaaataaataaatattcaacttatatataacaaatagtccaataaatatatcccctttaataaaaagttagtaaatagtaaatatcatattaatagacttcttaataaattaaagaataaaaaaacattaacaatcaatacatttaaaaagtgattctaattaatttcttaagacatcttatctaaaacttttgccataatattttaatgagtaattatttaaatctaaaataacaatgtagtacataagcacgtcaattattatcctcaaagagacaaaaatatcagtgccaagtgaatgactaggctaggctaggctaggtgttgtgtgtgatggggaatcaccagggcccagcttctcttctaagatccgaatgtccttccaagaagttcctgttccagcttctcttcttcgtgggtgtcaccggcgctgtcggtcaggaattcctcttcgtcctctccaaccgcgacttcccctatagctccatcaaaatgcttgcgtccaagcgctctactgggcgccgcatcactttcgaggacgtggaggagctgacaacggagagcttcgacgacgtcgacatcgcgctcttcagcatcggtggctccatcagcaagcgcttcggccccatcgccgtcgattggggaacggtggtcgttgacaacagctcaccgcagtgaacccggaagcaatgcaaaaaactgagtcaactcggtaaactcttcgagtcaaccgagtttatcgagttgactcgccgtttcaaccaagtcagcccattttccatttcaactaccatttcaacacaatttttgaagcaaaaatgtataaatgtctatttctaccgagttgaaacgccgttttaacaacaacaattccaattagaaatagccacttgcaagtatagttatgacttatgagaaattttaatctcatgtaggtattgcttatggtaggcactacattcagattttgggggtgttatggctcaaaattttaggggatgcctatcttaatcacatttgtatctaccggaattaactcattgctccggcaacatgatttgcatgcaaccttttgaaattttattatctcttgaacttattgcacgatgaaacaagaggaaaagaataagacgttagacggatagaaataaatacgaaataaagtaaaaaagatgtgttatttagatgaataaaaataggaaggaaataagtgtagaaattcattatttatgtttgttttgaacaaaagaaagagaaaatacaaacaaatgaattatttgaaaaaaaattatacatttttaaaaatgatttccattatttttctaaaataagattattatttttttactatataatatacttgatttttaatatataagcagcactgatggctgctctgcaaaaccaatcttgcctcaaactagtttgtttaagcttaaaataagtaattttaaaataaatattttttaataagcccttatttcataaacaaataacgttatcaaaataagcagaaaattattttttaagcataaacacaatttagacaaatacactaaaaaagaaatcagataaatggaaaagaaacaagagggatagaaataaaagtttaatatctgtatataaaacagttttaggcttttacaaattatcattcactcataacttactagtttaaaagataacaaatttatcatacatacacatggaaggaaggggaaaagctttgacgtgggttatgcagtatagtctcaaattaaggcgagaacaataagaaaggtaatatttcatgacagaaaatgtagaataatctcaaatttaaacacaagcttgattgttccacaaacaaataataatacagtgtcttaaagttatgccaatgtctgtaactctatagtaacgtagtcctgtttggacaaacgataatatctagaccagaagcgtttgtctaaaaacttaaattgaaagagaagaaacagaagtattgggaaaaccccattgaagccactgcataagaaacccacttggaagtgtgatcaaatatcaaaaaggaggctgcagtgaaagccacaaccatagcagcaacggagataataagtaaccaacgcccaatagtcaagctgggatgtagtgatttcacaaattcgctatgtgcgaatcttgatgaagtgaaatttgacaagaatgagagtaaagaggcagaagaagtgaataatgcaactgcatttgtcaatatgaagacagtaaaccgtgcattggtcttatcacctggaatagtgagagcagccgcaaatgctacggtagcaacaagtgttgacacaagcatgccagattcggctattcctttggctgtttccttaatttcttcagataacttcttgtgttcatgataaaagacatcaattggtctcttgttcatgttgtttctcattgttcttagttcaccaggaacattactctccacgaactattaacaaatcaagagtatatgtaaatgatggtatcgaaatgcataagttaattaatctttcaattatcacttaataaccagagcaaattaaagcaacagctcctaagatttagtgtaattacacaaacatttcttcaggtattagaataaggtttgaggagatgttaacttaatgctttcaagcatataagagatgttagtgtaattttttttaatttttttaaaaaatagtgtaggaaaataataaaattaatggaattacatataattacacaaaacctatcggaaattattgtaatttgctctaataagtattagatattaaatttgtaagaaaaagaatttcaaagataagatattttaaaaataaatcttaggagtgatatttattgttacaaatgcacttgtataatttttaattaaaattttctatctatatattggctgtttaactattatgctaaagacaatggataacaaattttaaaaaactgttacaataatcaacaaatacaaacaatgatttctatttttaattaaaatttgttactttaaatatttaaaatcagtctagttaacaaaagcctaaaattagtggaattttaaatttttaaaataagattgctagaactgatggatcccatgcgagtgaataaagaatggttgaacaagaaaaactaagcaaattaattgaccttgaaccattcgagctctctttgaatttgaatgcttgctcttaaactggacaattcttcgaagtcaccttgtggaagatgcgcagccaagtgtagaatgttgttaccatcattgtccactgttcgtagtagatgctctattaatccccgtggtatacgtatactattaaatattttttttgtcgaaatagcacaaccaagtacagtaggttccgtccatggggcccgtcctttattgtcactagtttacgattcatgtcaataagcatattcacagcatcaacatttcccgattctattgcatcaaacagcactgacgatggatgagttatcaactccattatccgcttatgttccaatttgttaacttgagtcaataaattttcaaatagccgaccagctacttctgatttcttgtcgtccttcccgtttatcatgaggcctatatatagttgattggtccaaccaatgtttaacatgaaatgaaacaaacaaaagttaattaaattaaaattttactcttatatatatgaagcaccattttttatctctatttcaaaaattatatttatattttaatccttacctgaaaaaaaattataagatatttttgcacatgtgactcatgtgttggcaaacattaatttgtgttattagaataactcaacaacaaacatctaataccattattacactggatattgataattaaggactaattcttgttgggtcccaaaccccatctatttgcggaagcgaagtaaatctgtgaggagatgggaaattatagaagcagaaaaatatcacccagagaacacaaaacaattttaacgtggaaaacctcctcaatgtgaagagtaaaaccacggggcactgacccagaaaaatcttccactataaaagtaggattacaaaagatgatctctctagtaagactagaggtatacactcacaaaatttcttcacccactaaggatggctcacactatttttatctctcactgggaggatttctactctcactaaaattagtggatcactcttttctctctgaggaactttttctctcaggtttttctctgatttctgttctgctgaactgaagaaatgaattccctatttataggaaattgaagcgcacagtaactgcaaaaaaaacaaactgctttcggtgcgtattttttcaaagtgcacagtaaagtgcacagtaaattctaatttttcaaacgcaccgaaaacgcacagtaacaagcgcacagtaaaattaattttttattttgcgtggaccccacatgctttgaaaaattttcttctccgtctgttacggaggaactgtgccaacaaatctccccctttccgacttaatcaaacggggttatcaaaccagcacctttacaacagtcttcaaacttccatgttggaactgtcttagtcatcatgtctgaccagttcagatcggtatgaaccttctcgagatgtagagacttatcttctaacacttctcggatccaatgatagcgcacgtcaatgtgctttgatcgtgcatggaaggttggatttttcgctaagtgtatggcactctggttatcacactttagcatgtatttttcctgactatggcctagctcttgtagaaaacttttcatccacactagctctttgcatgcttcagttgctgcaatgtattcggcctcagttgtagacagggcaacacacttctggagtttagactgccaggaaatagctccccctgcaaaaatagtcaggtaacctgtggttgacttccttgagtcaccgtctccacctaggtcagcatccgagtaggcttctaactcgggttctcctgttccaaagcacaaacatttgtttgacgtacctttgagatatctgaatatccatctgacggcattccaatgctctttgcctggatttgacagaaatcgactaacaactccgactgcatgagcaaggtcgggtcttgtgcataccatggcatacatgagactgcctacagctgactgatgtgggatttttgacatctcgtctctttcttcatcactggttggactttgcttctgactcaacttgaaatgtccagccagaggagtactaacagtcttgcattggtccatgttgaacctcttcaggattttctctatgtacttttcctgagataatcatatcaacttctttgatcgatttcggataatcttcattccgagtatctgtctcgctgcaccaagatctttcatagcaaacgacttgctcagggctttcttgagagcattaattttcatcatgttttttccaactatcaacatatcatctacatagagcaagagtatgatgaagtcattattgtcatacctcttgatgaacacacagtggtctgcttgagtcttcttgaagtcgtgttgagtcatgaaagattcaaacttcttgtaccattgcctgggtgcttgcttcaggccgtataaactcttcttaagtctgcatgccaactgttctttgcctggaactacaaaaccttcaggctgctccatgtatatttcttcttctaagtctccatgaagaaaagcagtcttcacatcaagttgttcgacctccaaatcttgagtagctgcaattgctagaacagttcggatcgacgtcatcttcaccactggtgagaatatctcttcaaagtctatgcctttcttctgattgcatccttttaccacaattcgggctttgtaccttggctttggattgttctcctccaccttgagtttgtacacccatttgttcttcaaagctcgtctgccctttggtaactcaaccagatcgaaggtgtgattctcatgcaaggatttcatctcatcttgcatggctttcaaccattcttgtttttcagcactggatgctgcctcttcataactctgaggctctccttcttctgcaacaattgtatattcatcagcaggatatctggtggatggacgtctaactcgggtagattgccgagtttgtggttgtacttcggaatccggttcttggacttccggatgttctgtttctgtctcaccttctgctggtggctcttcctgttgttcaccttcctcattgttttgttggttggtttctccccctgcttcagtatgaataggggagacaggatcttcttgacgaattacagctcgtaccttgggcttatgtatatcttcaattgtctgatcttccaagaacaatacatctcggcttctcacaatcttcctgttgacagggtcccaaaggcgataaccaaactcatcctttggtgaaccgagatagacgcactccttggtctttgaatctagctttgctcgttcatccttgggaatatgcacaaatgcacgacatccaaataccttcagatgctcgtaccttgcctttctgcccgtccagacttcttctgggatatctccttctagaggtcttgaaggtgatagatttatcagatcaactgcagttctgacggcctctccccagaatgccttgggaagcttggcatgtgacaacatgctccggacccgctcttcaatggtccggttcattctttcggctacaccgttcaactgaggtgtctttggaggtgtcttctccaactttatacctgccgccctgcagtacatctcgaatggacctcggtattctccgccattgtctgcacgaacagctttcagcttcctgccggtctccctttcaacccttgcatggaactccttgaagacttggagtacttggtcctttgtagttagcaagtatacccacacttttctagtgtgatcatctatgaatgtgacaaaataatatgcaccacctagagatttttctgacatagtacacacgtcagtatgaacaagatcaagaatataccttcttcttctaggctggtcaggtctcttgaatgaaattcgacattgtttgccggctaaacaatgggtgcatgtttccagaagttgacccttcaagttcggcaacaattccttcttggcaagtatctgcaaacctttttcactcatgtgtccgagtcttttgtgccagagctccagatttgattcatctctcgtggtgttgacctctgcattgtcgatcttcccttgcatgacatagagagatccttctttctttcctcgagctaccaccaagttacctttggcaagtttccatcttcctccaccaaagtggttttccataccggcttcatcgagtttacccgctgagatgagattgagccgcatatcaggaacatgtctgacctcctttagaattaatctacagcccatatcggttgtcattgtgacttctccaactcccactattttgctggtaacctggttacccatcttcacgataccaaagtcgcctctttgatatgatgagaaaaactccttgtggggtgtgacatggaaagatgctcctgaatctacaatccatgaacagtcgtcatatgcaacattaagataattatcctcaccgattaagaaaacatcggcctcggctttggctgctacggctgtggtgttttgctcttctttcttcttcggatctatttggtccggcttcacggtgccatttttctgatctcttttgagcgttcgacattcgaacctcctatgacctggcttcccacaataatagcatgtccagtcagatcttgattttgaccgtcctcgagacttgtctcgatttcggtttttacttcttcctcgattctctgatctgccacgattctccgatctaccacgattctcgacgacatttgcctcgttctggctggtcatcccacgttcttttcttctggcctcttcattcaacaggctatctgcaactgaatccattgtcaactttccttctggaaccgagttgctgagtgtcaccaccaaagtatcccagctctctggcaatgagctgagtagcaaaagtgcttgcaactcatcatcgatcttcatgtcaaccttagttaattgattgacgagccctttgtatgtgttcaagtgctcaatcatgctttgcccgtccctgtagactaacttcacaagtcggcgcacgagagctgctttgttgcgtggggttttcttctgaattaaagagtccaactttgtccacaactcataagcgtttgtgtaggttgatacgtgctcgaacagactcttgtcaatatacttgcgaatcatggcgaccgcctttcggttgagcagttcccaatctttgtcgctcttcccttctgtcttgtttgctgacaaaatcggctcatgtagctctttacaataaagatgatcttccatcatgggtttccaatacgtgtagttctctgcggtgagtttgaacatgtctccatcgagtgctgtaactccttccatttatgaacagtaccgtatgtataaacagtaccgtatgtgtgaacagtgtcgtacgtatgaatagtaccgtacgtatgaataataccatacgtatgaatagtaccgtacgtatgaatagtacagttgtctaaatagtgatgaacagtacttaccactatttaagccagctctgataccactgttgggtcccaaaccccatctatttgcggaagcggagtaaatctgtgaggagatgggaaattatagaagcagaaaaatatcacccagagaacacaaaacaattttaacgtggaaaacctcctcaatgtgaagagtaaaaccacggggcactgacccagaaaaatcttccactataaaagtaggattacaaaagatgatctctctagtaagactagaggtatacactcacaaaatttcttcacccactaaggatggctcacactatttttatctctcactgggaggatttctactctcactaaaattagtggatcactcttttctctctgaggaactttttctctcaggtttttctctgatttctgttctgctgaactgaagaaatgaattccctatttataggaaattgaagcgcacagtaactgcaaaaaaaacaaactgctttcggtgcgtattttttcaaagtgcacagtaaagtgcacagtaaattctaatttttcaaacgcaccgaaaacgcacagtaacaagcgcacagtaaaattaattttttattttgcgtggaccctacatgctttgaaaaattttcttctccgtctgttacggaggaactgtgccaacaattcttaatattatatatatatatgtatatatataactttctaaaataagaatcaaaatggaaatgatgtcaaataagatctaaattttgaacttgtgaaagcttactgaatctttctacaaactccctcagcattatgaagcctgtccccggcgtatcttcattttgtgcagtaatgggaatagtaggtcgatgtttttcaaataatcccgttgtcaaatctgttatatgcacaaattaaatagtacgaggcaaggtaaaactccaactaaattgaaaaaccacagacgagttcatatatatatatatatatctttctaaaataagaatcaaaatggaaatgatgtcaaataagatctaaattttagcttagcacacacaaaaaagaaaaaagaagccattttcaacttgtgaaagcttacctaaaatttctagaggcttttgcgccagcatatgcaatgctgtaaggcggtcctcttcatttcttgcaatggccagagcagttggatgtttttcaaataatcgcattgccaaatctgttatacgcacaaattaaatagtacaaggcaaggtaaaactccaactaaattgaaaaaccacatacgagttcatatacatctccttatatatatatatatatatatatatatatatatatatatatatatatatatatattnnnnnnnngtatctgatcggctcaatgagttcgattcagtttgtaaaacatcatgatatgtaaaagagaactagattaaaaaaaaggataaataaggttgtttagttagttttacacttaccaaacatgttgaacctaacggttattaaaaacagtcgttcaatatccttgaaatccattatgtcaagcattttgttagaggacaaaatgtccaccattctgtcggaaccacgtaaagcagccaagtgaagtggaagcatcccatctgagtttggtattagcatgtcttctggcctcatacgcttaaccaacgcattcaaaagttcaaggttgccttcacttactgctacatgaagagctgtctctccactaacatttaacggaaagcgtttcatatcaggacatttatcaaaaatccttattaaagaacctgcaatcctttcaaacttcacattataaaatgtcctctttatataataatcataacttttagtatttagctgcaaagaagacccttttaatttctcgtttaccctaaatcggtataaaaattcttgtaaacttgtctcaaattttgaattcctaatagtttcatcatttgtaaattgaaatgtacctgagaaattcgagattatatatgtagtagtagaaggaatccaattatcaatcacctttaattaagtttgaaatttgaatttgaatttgtgtttgaaaattaactctatgatgataagtaaaattgtttttgagagaagtaatttattttttcttttcttcagttgacaaaaaagcaaattgatcttaacatgtgacttatacttatttatatcatactttaaaagccattctactttttttatctttccaataaaaaaaataatttctaaacccattgttgaaatatcattcgtataataatagtataaatatttattttttttaacgtcaagcggtttcaaattcaattttttcaaaatgtaaaataaacaaactcttaagacatgatctctgaactgcactctcttgtgaatgcaatagtttcaagtgtaacttactctgctcttctggagtcatttcgttcactcctctactttcatttgttggtgccggtgagtttgttgaagtggcaattggagtttgctcatgactttgattaggagtatgatctagtgttggtataatctgaattatgtggtcatctgaaacttcgatattggagttcatgattcaattctagacaaaatgaagtgaattggatacctctatgaaattccctgttcgattcgatcagtgttgctttttctttccagcctgcgaagcttgaaccatgttatatatggtggtaaaacaagagcccttaattaattagttttccaacttgcacttaaaataattatttccaatatgacattttgtggattacagcaatgttaattgaatctgctcaacatttcaacccaacagttttcaaaagtttttaagttgaatgatttctaaatttatataatattaattcatttttaaagtgaataaatatgttcattaaattttttaacagaaaaaaaaaatattcattataaaaaaaattatattcattaaattctctggattagcgagactcgctatcatgacactgttaattaacttaatctcaatttaatattatctttctttgttgtacaatgatatgatatatttacaaacttaaaaccttcaagttcctacctactcttgtattgttgacgaaccatagcgatggttatatatttatccaacttccgttgacgcatttaattatatgattatatcctaactctggtctttttatactagttataatcaattactccaacaaccattgaattcaaagctaatactagatgcatgttattatcggaatatgtataaatttattaaactcactccaacaaccattgaattcaatgttaattcatttttattatatcctgactctggtctttttatattagttaaggatattttgattcaatatatttaatagttacgttgctaattatcattatgatatttttttgtcaaatatgctattttattgacggtataaaagtcaacgaattcatggatttattgtatttttttatttttattgactaaaatttaaattttcatttataaaaaaaatgaataaacgaatttttagcattctacacataaaaaataattattatttatccaacacatttttataaaatttaggaagacgtgggctatgatgggagaggataatcgatctcttaccgtgaaaaagtattttatgaccatcagactactgtcttcctatttcttgtactacccttttcctcttttttcttctcttctttctcattcttccactccaggattgatcctgaaaattctttagttcggggcgaaatgaaaaaaataggtccctaacacataaattttttgaaatacaaataatattaaaactaggagatgaaaaaaataggcccttaacacacaaattttttaaaatacaaattatattaaaactaaggaatggaaaaaatgggtctctaacacacaaaaaataggtccctaacacacaaaaaatgggcccctaacacacaaattttttgaaatacaaataatattaaaactaagggatggaaaaaatgggtccctgacacattaattttttgaaatacaaaagatattaaaactaagggatgaaaaaaatgggtctttaatacacaaattttttgaaatacaaataatattaaaactaagagatgtaaaaaatggtccataacacacaaaatagaccccttagcacaggtttcatttttttttttaaattacttaagctatcggtgtaaaaaaatttgggccctgggccggcaccccgttcaccttgccccagggccgaccctgctcctcttttcgtcttagcgacaacggtggtgcatgacggccagtgatattggggatgttgatgcgtcattctaccacaatatttcaaccggagaaaaagcatggaagacgaaacaatcataaagcttgatataactattgtctcacttaaacccaaattggattcaattgaacaaaccagattttaatctcccaaagttttgagcttttttatatttgttgtgtacgtgttgattttttctcaagggtgtcaagttacgagtttgtttcttgcataaatgttgtttctataccattttactctcaaatttgagtccaatttgggagaataaaaaatctaagattttggttttgaaaatcagatgaaattttttatatctggccttgttttctatgtttagatatgtgatgggtggtggtgtgttgcgactattccgcacactacggcaagtgcaccgatcgtttcaagtaataaactaggtaagtgagtatcgttctccatagggattggggtgaagttcacagtaataaggagtcaatgtgattgaaaataaaaacagaaaatgttggaagaaaatagttggattgattggttgagtaaaacagaaattaaaatcaacagtaaattaaattaagaagttaccaatggaaaaacaattgtggtcaggcgcaatcccctttgattcctccctccttcacttgaatggtttattagtttaatttactcgaatgataaatctctcctaatttcgtaaatcctaatttattagcgacttatccctttaattcgatcgagaattctaatcccttagcaatcctgtcaaactaagcatttagagaatatatcataagggttcttgttatgattgttcagagaacaaatcttttctaaattagttaatccctaatcccttagtgaattaaccctttaacctgaatcgaaaacctaattccttagtgaaatctatcagtttaagcatttaaaagaccatattataatttctgcagctacgcatccctatccctaggtgataaacaactgttattctaaacaggttagaaattagaatcccaacgtccccattgcgaatcctaaccctaaatacttaattgaagtgatcagttccaaataagaatggaaaataagaatagaatagaataaaacaatcaaaacattattattcaataccagtcaaattacagaggagttcagatcagttcatggccttcccacaatacaagatttagcatgccataggcctcaagaacatcaaagcagtagaataatacatgactgtgctgaaaccctagccttgattcttgatttccagaggtttagaatgatgtttacaatgtaaaagatgatatccagatgtccttttctcagttcagaggcctttcttttatagatagatttaattagagtaataagacctaaaactgtgctcaaattcgaaacagataatttatttaaggaaacagaatccttgtggcgcgatccgcgcggagtctcgcgctaaccgcgcggcctgttcgaacacatggtgctgatcgcgtggacctccacgctaaccgcgtggagtcttcgagaatgaaggtctgatgctgagcttgtggcgttgatcgcgtggatgtggcgcgatccgcgtgggttattcgagttaaatggcatggcctcatgtccttggcgcggatggcgcagcttcggcgctgatggcgcggtgcttgcggccttttcacgctaatcgcgtgaactcccacgctgatcgcgtgggatcatcgagaatagggccttcaattcttcacctggcgcgatccgcgccggacttgaaatcttgttttcttctccttttgccttgaacttcctctttttaacctgaaattgctcaattggtaatgaattgaatttaaaacaaataaaatgataaactaactattcttattctattttcctaattatttaactaaattatatcctaaaactagcctaaaactaggatgtgtttgcaacacatcatggtgcatggtcgtggttgtggaatagggaaaaaggaagaaagggagggttgccgaaaattactcttaatttaggtgttgtagtcgaagacaagaaaaatggaagaagaaaggtgaaaaaaataaaatgatgctgccagaggtgattttcggcaatggcgcatagtggctaacgacaatggtgaggaataagtcagagggataaatcgggaaagtcaagaagaaaagaaaaaaattcatccgtgggattaaaatttgataaatctaatggtggaaattcactttatcattagtgagagacctattacactctcccacactagtctgtgttagattagggattaaattgtacattatgaaagatttaagactaaaaataatattcaacgaaaatacagagtctaaacatatatttttttcaaaaatatttcaaatcttgctttgaattagttgtgtgacatttgatagcgagtttcatactaaattatcccatatgcaagatgtaactctatatataagatttaggatttaaatcaaggataataagaaccttaaatcctaaattagaattatagatcaaaagatgtgttcacatgccaagtgtgaagatgattctgatgtattgaagcagaatcacaaacacactcaaagcaatgaaagcatggaaaatgtgccggaacttgaagaagttaagcagagttttccaataagcaaaccggctgaagtgtccattcgaaattttgacttaaatttggacccagatgaggatatggattcattaaacacaccaacttctatcccaactagttcatctgcaaaatcagtgtcagaagagaagcatgaggaataccctggatgatccttgtctgaaatggaaaaaatgtagatgaacatgaagaggttgatgaagatgaagaggattatgatgaagaaatgtagatgaacatgtgttggtttattcattacttctcatataggcaggagcggatccagaaaataaatcaaggagaggcactcaaaagttcaaatacatatccagaaaaataattacaatgacatccttctaggccttattttttggaattccttcataattgccttattatcaatgctttcaaatacatctttttcaatataaggcactaaacaatcattcaaccattcatcccccatccaattacgaagtgtagtcttgatgtatttcatagctgaaaatgctctttccacagatacagttgttacaggcaaagttaatgctaactttacaagtaagtaaaccaaaggatacacaatatgttttttcttttcaatcataatcttggcaagctcagctattccttgcaaattcaagaaatcagaatcactttgcacatcaataatatatgtgtcaagctgatattcaagcatgacaaaatcattcaaatcaaaatttgaaggatagaagttagcaaattcacacaacttattcttgtcaaatgtcgagaaagagttgcacggatttaaacatgtcaagcatttcagcaaattcgaactaacttcactaaaacgatcattcaactcttcaagttgagtatctatcactgcataaaatatgtcaaccttaaagtgatgcagatgagtaactagtcctctacgttttgctctcccttgtaatgcaaatacactttccatatcagggatatctatatcatgtttgatacaaaatgcagaagtcttctgaaatagattatctcacccattatctcttgtcttctgtaataacacttttgaaacttttacaagattcatagcattcacaatatcttgatcttttctctgaagtgcttgggacaactcacttgttattgctaagaccttgatcatcatgttcaaaaataatacaaattcaaaagtttgcatatgcatcataaggccaaaggctttagacctttttgcatgtgtaagggttgtatcatcttttataatttctagcacatcaagaacaggatcaaacaatgtacacagacttaccaatgattgctaatgtgagctccaacgtgtgtcccctggtcgtgacaaacttatttctggattcaagtctctccctgattgaacatcatcgcttgcaatacttttgaccatctcatcaaattgcttttctctcaaaatatctgctcttttgcaagaagcactaactacattacagaccaacggtataaaagtaaagaagtcagtcaacgcgtaaaccttttttgcacaactcgctaaagctaactgaagttggtgtgcaaagcaatgaacatagtaagcagaattattttcaactaaaatcaagcttttcagaccactaaattgtccactcatattacttgcgacataataaccttgaccacgaatctttgtcaagctcaagccatttttggcaaaaattaactcaattgtttctttaagtgaattagctgtagtatctgaaacatgaacaagaccaataaaacgttcaataatgtcaccgttgcagttcacatatcttaaaacaatggccacttgttctttaattgatatatcacaagcttcatcaactaggatagagaaaaaattatccccaatatctgaaataatagctttggtaactaaactagcagcaacattagtaatatctttttgaatcaagggagctatcattttgagattctctgggcattattcaaagatacattatttacctcttcattattttcacaaaggaattttacaagctcaacaaaatttccctgatttattgaagcatctgtctcattatgtccctggaaagccaaaccttgtcgtatgagatatcgaatagaaccaatcaaacgaatacaataatcctatttggctttgtcagaaatgccaaacataaaaatgtcaatatgttgattttcattcatcaaatctttggcagcacttaagcacaaattatgagtgcttccaactttcccaatatgtttaatcagccattgtttgtccttccatttgctaaatccttctacaacaaatgaatcatgaccaccccttccatcaccatgctcacaactaaatagataacaatgcaagcaaaatacagcatcttttgattcactatactcaaccaagtgccaaactcattgtatcattgaggactaaatctacgcattttacccccaaattaacgattgaggaaagttgtcaagttttgaaggaccattcgttagataaattcttcgaatcatttccctttcttgatcactctttgcaatgctcataatagaaagtcttttacccggatcaggaacatacaaatcattttcctttcttgaacactcatttggtttatcttgaactaaatcaatagatgaagaagattcatgttgcggactcggtaagtataccgatcgttccaagtaatataatgataaaaaagtgtatcgttcccacgaggattgtttgaccaatgaaattataattaaatccaataggttggaagacaaatatttatgagaaattgttgttgttgtgtgtgtaacaattaaattaaacctaattatgaacattaattattatcaacaagtaaataagattataacgatatgtaaagtaatgtagctagggtaacccacactaaatgcttcctaccttcttacatgaattgtctactacattcatctattacaagttacttaatacatgcatcttcatacagtaatagctaggtcctactcccatagtggccttaaccctttaacccaattaaataccctaattccttagtagtacccgttaggttaagcattaaatgatgcattaaatgtttgcaagcatacactactatccctagacaatgtaaaacttgtcactttacccaagtccaagcatagaatcccaacattcctattgtaaaccctagctttcaatacccaactagaatgatcagttccagcaagatagaaacatatatgcaatcaaagtaaagtgaaataacttgatataaatgacgaatagcatccaatacaatccaaaggaggttacattcagtgcttagccctaactacaatatgaaatcagccaaacctcattgtggttggctgtaatacaaaaaatggcatacccagctgaagtgcaaggaaaagaagatggagaagaaccttctcttgagccttcaatctcctaaaaccctagctaaggtacccaagctcataaaaccctatttttgtgtttttctccctccaaaaattcgtgcattcaatgctgaggcttcagtatttatagtcctgcttgtgaagtctctgttttgcccttggcagctttaattacacagcttctgtcgacctgtggcgctgatggcaccaacttacagagcttttggcgccaatgacgtcaacctggcacggatggcgttaggatccagagatgatggcatgagtagagtcgtgtctgcgttgatggcgccaaaagacagtttgttggcgctagtggcgctggactctagaattgtggcgatggtggcgccaatcatggcgctggtcgctccagtccttcttccaggcttgattctttctttaatttgctacttttgattgatttcctggcaatttacagtattagcttaaatcaccacataataggcaatttatcaatgtttaatgctcaatttcttgcttttgatagcttaggaaccttatatgttaggcgcatatcaattcacatcgagaacgtttagcactactaccacttgactttgtaaaaaaagaatctaaatacctttccattctaaaaaaatgaaaaatgacaaaaatgaatcaatatataagtatgcatttaatttggaatcaatatactccaaaatattaacaatttgcttatcctaaagttccatgccctgtaaaacagaacaaagatttcattcggatgattcgaattaaaactatcaaggtatcatgctttccagttccaggcaaaatatttggaaatgaaagcttatattatctcttaaaaaacaaaacaaatgcagaattgaaaacaaaacacattttcccaatcctactttcaaatgcattatggaaaatgaaacagacaaacaataatctcacaaatcccagaataatgcagttatgcacatccaaaagagaaaacctcaaaatggaaaacactcaaaattgagacaaataaaacactgtccccaatctaggttcgcccctgatgccaccacaaaagaattgctaagcaacaaagaagttattgcagtaaaccaaggcatggacagactaaattaaccttcttatcttttcttaaatagagaatgcttttaaaaccaataacttatgatattgcagatttgcagtgctcactggcactcttcacaagcctcacatcatcacatcattcacaatttcacatggaaatgttttgctttgataaatgagaaattaacataactcaaaaaatgagatgcacgattcactcattcacgggaatcacgggtattgggtaatcaaaatcagtaatgggtattgggtagccattggattggagacttgcccgacttcgaggctggaggagtgaaggttgttcatcgctgccggtgaagatgaaagacgatggtgtcgtcaccgtctctcacggttctgattctcaacttctggtggtctctctcgatctcgtgatcgatggctacggtcttaggtgagcgactaagcaggagccccgaaggtggtgccgtggtggccgatgatggcgactggcgaaggcggcgaggcgcagttctggttcgagtcttctggtggtctctctcggtctcacagggtctgctagtgtagggcactaggactaaggaacgcgttttgctgcagaaaaaagacaaggatatttgtgtaaaaaaatttaaaatcagggacatattggtaattaactttcaaaatttaaagggggggcactgcccgccaccccaatgtttcacatacgtccgcctttgcatataggcccgtcattgaaatgttcttatggggaattagagtagattttgtaggagcaatgttagatagatacttactcctttgtagtttaggaagattaggagggatagggcattgagtactctccttataactcttgttttagaataaaagtggagatatagattgttccaattagaaatagccatttgcgagtatagttaagacttatgagaaattttaatctcatgtaggtattgcttatggtaggcactacattcagattttgggtgtgttatggctcaaaattttacggggatgctgttgcgcactcgacaagtataacggtcgtacaagtaatagagtgataagaaaaggatttgtcgttcccaacgaggattgtttgaccaattaaattataaacttaatcgataagttggacgataattgaattgaatagattgttgttgttgtgtgaagtaaatgaaaagctaaatggaaacatcaacataaacataaatgtaaagcattatatacaagatagtggttgtaccaatcgtagcctcaggtaattaggaactaacattcctagcattcttcatggattaattgcaacattcatttacactacctattcagctaatgtgttcttcttatattgactaagctttgatgtctcttccacttagttctttaactcacattccaaccctaatctcttagtgatcttccgcaagttaagcattaagcaaacacataaataagtcaagctgcaagcacccatccctatgtctaggtgatgttagcaagtcaccacacttggttccaagactagagccccaatatgtctattgtgaaccctagctctaacctctaacctaggttagctaagtctaagaaagagatgaaagcattcaagcaaagtgcagcaaaataacatagcataaaggaacaatagcattcactccattccaaatgaaagttacatagaatgtttgccctaaatacaaaaggaaactaaccaaacctcagagggctggccttggtacaacaaaaagaaagcatgaatgcagagatacaagcaaggagaggaagagaagaggggagaacgctcttcccctcacacccaagccctagctaagcctccaagccttctttccctcctttagtagtgattttcgtgctccagaggtcccttcaatgttgtgggttcaagtatttataagacggtaagtgaaaagccaaatatgccctctatcagtttgcagaattacacaaatcgcagctttccacgcttggggcgtgggttcccacgcctggggcgtggctatccagagaaaacaacatatggaggcgctttcccacgcctggggcgtgggcttccagacagatttgcaaaatggctcatctacccacgctgggggcatgggacttcaagcttggagcgtggacttcctgagcttccaaaaatggcttgaattgtgtgctttcctgctgtaaatatgttcaaaatagcacaacacatgataggaatggattcatcaacatttatcataaacttatgcaattctaagctatttgtcgatgatttttggcttttaatagcttggaagggactatatgctgggcgcatatcagatgcctatcttaatcacacttgtatctagtggaactaactcactgctcccgcaacatgatttgcatgcaaccttttgaatttttgttatcatgaacttattgcacgataagacaagaggaaaagaataagacgttagacggatagaaataaatacgaaataaagtaaacaagatttgttatttagatgaataaaaatagaaaggaaataagtgtagaaattcattatttatgtttgttttggacaatgaaagagaaaatacaaacagatgaattgtttgaaaaaattatacattttttaaaaattattttcagtatttttctaataagattattatttttttattatataatatacttatttgatttttaatatataagcaccactaatcacttctttgtaaaaccaatatcgcctcaaactagtttgtttaaacttaaaataagtaattttaaaataaatatttttttgaataaacacttaaacaaataacgttgatcaaaataaacaaaaaaaagctattttttaaacataaacacaatttaaacaaatacattaaaaaacagaaaattgtttattgttgcgtactcggcaagtgtaccgatcgtacaagtaataaagtgataaggaaaagtatcgttcccacgaggattgttgaccaattaaattataaattgaatcaataagttggatgacaaataaaatggataaatttgttgttgtgtgtgtatgacaattaaattaaatacctaattataaacatgagtattatagacagactatggagggttgtaatgatatatgtggtgaagtagctaacgaaatccacactaaatgctccctacctttgtacatgtattgtctactatcttcatcaaacccaagttactcacacatgcatcttcatacaatgatagctaagccctactcctgtaatgcctgagatttttaagcatgtaattaggcttaggattaaggatcatagatatgcttaagagtaatcagagaacagcttaagaaaagagttgagaagctatgtctggcctatggcgcgacccgcgtggcgtgtggcgcgacctgcgccatatatgtgtatatatgccatttctgtctggcattccacgcgagtagcgtggaggttcgcgcgagtcgcgtggtagatgcctcagaaaccaggtttttctctggagcaccacgcgagtagcgcgggtaatggcgcgagtcgcgtgagaggcccgagaatgtggcgcgagtagcgtggttagtggcgcgagacgcgtgagatcggcggatttgttttataaaaggccattttagggctaaaggggagagagagaaaagaagaaaaggaaaggaagagagagagaaaagccattgatgagttacagagctttctacttccttcatagctcatctaaacacctctgacccaactgagaaagtgatcagagccccgagataagagttttaccccgattgatttctgagaatagccaataaacagtgagattagatttctctgagagaacccttgagagctcggagtctaaaggcgaaggaagcctagattgagcgaatcagctgagggaaagtagttccctggtacttctgaacagtacagaggtaagaaactagagctctaatcgttggttctatgtagtgattttattggttatgggggtatatagaggggtgtttttggaggtgttaaagccgttattaggctcggactctgttgagttttgtactcagataattattctgagggagatagagccttgaatcatcattattgatgaagtttgattttggctctgagtcagtattagcagagatcaaaaggttgactatatgactagtctggaccttagagcagttgacaaagttgctcatgagactatatagatgaggattatgagtttaaactgctgatactgagaggttggtgttgagaaggcttaagcagagacatgcttgatattagcctgatttagagtcattacaaagactctatagccttgtatgggctgagatggatcctgttgaggatcagatgatcacttgtacagcgattagttatgtgtatagaaaggatgatagttccctttcgtttgaacgacttagaaccgtgtctgatacactatatgcttgttcttgtgtaggacgtgagcgtgagagctcaggtggtgttgaccacgaagccgggagagccggtaatctgtctagagcaggtaagctcatggttcttgtttgtgtgtcctctgctgtgttccaccatatatccactaggattatggttatgatatgtgtatctgtgagtagaggaatgtatatgatactgtgaatgatgtttgaaccctagaaaagggcaattgatatgttacaggtgatctgaacccagaaatgggggattttatgtatggccatgagttattgattgataatgaatccctgagaaagggaattaatggatgttgttccctgataaagggatatggctagcatgcctgagtaatgatgaaacttgaatgaacaagtatataaatgctgtgtactgctattctgatccctataaaagggagattgagatgtattgatttgctatgcttgaaatgtgaattgaactctgtaatagggaattgatatgcatagctatgatgtgattgaattgtggcatgtcttggtaaatgtgaaacctgtatgtgcatgttgtgctattataatatcctattgtagtaggataaatgattgagattgagaaagacctggtgagagatgagcctgtagtacacagaggagcctcctatgtggagatgtgcctatgtacacagtggtagcctttcccaggcaaatgtattgaattagaggatgagatggccttgtgatacatagaggagcctcatgagaagagatgtgcctatgtacacagaggtagcctcaccaaaaaggggatgtacctgatatatggatgagatgtacctatatatctagagaagcctccgctagggatacatgtaagagatgtgccgagtatatagatggagcctccctgagaggagatgatcctatatactgcgaggtagcctctgcatgacaattattgatgtgatgaatggcttcatgccatgattatgccttgatgttggctgatagatgagtatagcctgattgtagtcaggattattgagcattgatgtgcctgatgattgaattaacccttcactgatgataatggtgattgtggttgatagagatatatatatatatgtatgtgttgtgtattgatgtacactgatgatactgattgtatatatgatgtgatggatggtagttgccattagttagcctgttcgttgacaggtggacatgcattgttgtgcatgagatgtttatgaggtgattcactggtatgttaaattacttatatgtaattgtcagtgaaccaggggaaggaaataccttcaaggaccctgagtttactgagattttatatctcaccccgtttgtgggacttatgatgcaggtgattcctctggaggagcagagagatcccaaggcaagaagcctatgcagggatagctgctgagtgcataccttaggctagatgatatgagcatgtggctctgatgttttgtacctagcctttagatatgttttgnnnnnnnnnnnnnnnnnnnnnnnnnnnnnnnnnnnnnnnnnnnnnnnnnnnnnnnnnnnnnnntatgcctacccttgagattattttgggtatggattggctaacccgatatggggtcatgctggactgctgtcataagaaagtggttgtgccttcagatgatgtgatcccgagttcagtagtattcctttcagtgttacaagctcttaaggagctgagaggaggagctcagagatatatagtgttgtgtacagcggtgagtgaagatggaatggatatgtctgagattccggtggtatgcgagtttgttgatgtgtttccagatgagattacacagcttccaccggacagggggatagagttctccattgannnnnnnnnntgagtttactgagattttatatctcaccccgtttgtgggacttatgatgcaggtgattcctctggaggagcagagagatcccaaggcaagaagcctatgcagggatagctgctgagtgcataccttaggctagatgatatgagcatgtggctctgatgttttgtacctagcctttagatatgttttgttataccctgaggggttatttgtactgttttgtatacgaacagggatatgtatattcaccatattacgtgtacagtgtatctgatgatgacatttgttgatgtcacttttatatgtgcttccaaactgcttataactctgattgattgtctgattgtatgtgattatgtttggtaatgaccctcacagagaagggggcgttacattatggtatcagagcagtttggttagggaagcactgtgcatatggtgaattgtgtgttatgtatgagtgttctaggtactcattagggtatttgcatgtgtaactgttgagagtgagcttgatcaactcacccttttatgtgatatgtgcagtaccatggtgaggacccggaaccagacaggaggggcaggtgcagatgatcgccctgacccagtgatagaagccttaaccgctatgcagcaggagatagctgcaagcaggcaggctaatgaggccttgatgaaggctaatgaggagctgatggctgagcttagagctcgacagagagatgattctctacatcctactcctgaaggcgaggatagtcgcccgatggggggagctagccatcgtgcagaggggtatagccatcccagaggtggaccttcacagtcatatatggaggtggagactgtggatagagggagaatgctgacagctttccgtaagcatgatcctcctatgttccatggagagtatgatccagtggtggcagcccggtggttgcagtccctagagaaaatattcacagtgatggagtgttctgaccatcacagacttctctatgccacctacatgcttcatggagatgctcatgagtggtgggtgaccacgtcagagctgatgagaggtcagggagaggatgtgacctggcaggcttttgaggcccagttcctggacagatacttccctagagatgctagagagcagaaacaggcggagtttgaaacccttgtccaggggcagatgtcagtggatgagtatttggctaagtttaatgagttagccaaatattctcatttcaggagggagttacctgagactgatattcttgcagctaagttccagagaggacttagagcagacatagaggagaggatagccggcagtggttctagagatctgggaagtctggtccggcagtgcagacaggtggaggacatgatcaggagacggagtggtagtcatcctgtttcctccagtagacctgaggagaagagatctggtggtggtagtgcaggcccagtcgggagaggcaaggnnnnnnnnnncatcagtgatcacactgctcgaggactggatttgtctatgtgtagactatgttctcctatggaagtgaccacagcctctagagagcggtgtagagtagagatgtgctgtagagatgttcactttctgtatgatggcagagaatatagtgtggatttgtattgtttatctatgcctacccttgagattattttgggtatggattggctaacccgatatggggtcatgctggactgctgtcataagaaagtggttgtgccttcagatgatgtgatcccgagttcagtagtattcctttcagtgttacaagctcttaaggagctgagaggaggagctcagagatatatagtgttgtgtacagcggtgagtgaagatggaatggatatgtctgagattccggtggtatgcgagtttgttgatgtgtttccagatgagattacacagcttccaccggacagggggatagagttctccattgacttggttccaggtgtgggacctatttccatagctccttactgcatgtctcctttagagttaaaggagttgaaggcacagattgaggacttattgtccaaagagttcatcagaccgagtgtatccccgtggggagcaccagtcctttttgtgaagaagaaggacgggagtatgaggttatgtgtggactacaggcagttgaataaggttactattaagaataagtatcctttgcctcgtattgatgacttgttagatcagttgaggggagcttgtgtgttctccaagatagacctgagatccggatatcatcagattcggattaagcccagagatgttccgaagacagctttcaggtcgaggtatgggcattatgagtttcaggtcattccttttggtttgactaatgcaccagcagtgttcatggattatatgaacagggtgttcaggccatacctagaccagtttgtggtcgtgtttatagatgatatactgatctattccaggagtcaggaagagcatgctgaacaccttagacttgtcttgcagattctgagagatcatcagctgtatgctaagctctctaagtgtgagttttggcttccagaagtaaaattcctgggccatgtgatatctgcagagggtgtatcagtggatcctagtaaggtggatgctgtgatgtcttgggagaggcccaagagtgtttcagaggtccgtagtttccttggtcttgcaggatactacaggagattcattcaggggttttcacagatggtattacctatgactcgtctgactaaaaagggtaatccatttgtatggactcatgaatgtgaggagtgttttctgagattgaaagaaaagttgaccacagcaccagtgttgatacttcctgatcctgaaggatgttttgaggtatactgtgacgcttccaagcgaggtcttggttgtgtattgatgcaggataagcgagtagtggcttatgcttctaggcagttgaagcctaatgaggagaattatcctactcacgatttagagcttgcagctattgtgtttgctctaaagatatggaggcattacttgtatggtgcccagttagtggtattcagtgaccacaagagcctcaagtatctgtttgatcagaaagagttaaacatgaggcagagacggtggatggagttcctcaaagattatgattttgagttgagataccatccagggaaggcgaatgttgtagcaaacgccttgagcaggaaacatctgagtattgcctgcatgatgatctctgactgtgagctgattgagcaattcagagatatgcatctgttagtatctgagggtaccagtagtcttgagatgagaaggaccagagttgataatgagctgattcagagaatcagagaggctcagaaacaagatgactcgattatagatatgatgggtcgacgagagtttcagtgggagcctaatgatttgatgatgtatcatgaccggatagtggtgcctaagggcgagatggttgatacagttctgactgaggcccataaaggccagttcagtattcatccaggagctaccaagatgtatcaggatctcaagaggagattttggtggccaaggatgaagagagacattgctgagtatgtgaccagatgcttagtatgtcagaaggttaagattgagcaccagagaccgtcagggttgctacagccactacagatccctgaatggaaatgggatagcatttccatggattttgtagttgggctaccgaggacccagtctggatgtgattccatttgggtgattgttgatagactgactaagtctgctcacttcttacctgtgaggactgactacacggcagagaagctggctcagctatatgtcagagagattgtcagactacatggggttcctgagagtatagtcagtgacagagatcctaagttcacttccaggttttggggtgcgcttcaggagtcttttgggacccagttaaggctcagtacagcttatcatcctcagacagatggtcagactgagaggaccatccagacgttagaggatatgttgagagcttgtgccttggagcaaggtaccagatgggatagatatctacctttagtggagttctcgtataataacagttatcatgcgagcttaggcatggctccttatgaggccttgtatggccggagatgcagaactcctgtgtgttggacagaggtaggtgagaggcagttgttaggacctgatatggttcaggagacatctgagcagatcagattgatcagagataagttgttgagagctcagagtcgccagaagagtttctatgatcataaacaccggccgctacagtttgatgagggcgaccatgtgtttgtgagattatccccagttactggtgttggacgggcgttaggtgtgaggaagcttagccctagattcattggtccttaccagatattgcagaaggttggaccagtggcgtacaggttagctttaccacctcagttgtcagggttacatgatgtattccacgtgtcccagcttagaaggtatgtatcagatccttcacacgtggtggagcctgactcagttcagatcagagagaatctgactagccctatacgaccagtgaagattttggaccgcacagagaagaagatcaggagtaagaccattcctattattaaagttcagtgggatggcagatcacctgaggaagcgactagggagagagagcatgagctgctacagctatatcccgagttatgtgccaggtatgatcttgattttgcggacaaaattcttaaaaagggggggtgtaatgtaatgcctgagatttttaagcatgtaattaggcttaggattaaggatcatagatatgcttaagagtaatcagagaacagcttaagaaaagagttgagaagctatgtctggcctatggcgcgacccgcgccatatatgtgtatatatgccatttctgtctggcattccacgcgagtagcgtggaggttcgcgcgagtcgcgtggtagatgcctcagaaaccaggtttttctctggagcaccacgcgagtagcgcgggtaatggcgcgagtcgcgtgagaggcccgagaatgtggcgcgagtagtgtggttagtggcgcgagacgcgtgagatcggcggatttgttttataaaaggccattttagggctaaaggggagagagagaaaagaagaaaaggaaaggaagagagagagaaaagccattgatgagttacagagctttctacttccttcatagctcatctaaacacctctgacccaactgagaaagtgatcagagccccgagataagagttttaccccgattgatttctgagaatagccaataaacagtgagattagatttctctgagagaacccttgagagctcggagtctaaaggcgaaggaagcctagattgagcgaatcagctgagggaaagtagttccctggtacttctgaacagtacagaggtaagaaactagagctctaatcgttggttctatgtagtgattttattggttatgggggtatatagaggggtgtttttggaggtgttagagccgttattaggctcggactctgttgagttttgtactcagataattattctgagggagatagagccttgaatcatcattattgatgaagtttgattttggctctgagtcagtattagcagagatcaaaaggttgactatatgactagtctggaccttagagcagttgacaaagttgctcatgagactatatagatgaggattatgagtttaaactgctgatactgagaggttggtgttgagaaggcttaagcagagacatgcttgatattagcctgatttagagtcattacaaagactctatagccttgtatgggctgagatggatcctgttgaggatcagatgatcacttgtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgatatgtgtatctgtgagtagaggaatgtatatgatactgtgaatgatgtttgaaccctagaaaagggcaattgatatgttacaggtgatctgaacccagaaatgggggattttatgtatggccatgagttattgattgataatgaatccctgagaaagggaattaatggatgttgttccctgataaagggatatggctagcatgcctgagtaatgatgaaacttgaatgaacaagtatataaatgctgtgtactgctattctgatccctataaaagggagattgagatgtattgatttgctatgcttgaaatgtgaattgaactctgtaatagggaattgatatgcatagctatgatgtgattgaattgtggcatgtcttggtaaatgtgaaacctgtatgtgcatgctgtgctattataatatcctattgtagtaggataaatgattgagattgagaaagacctggtgagagatgagcctgtagtacacagaggagcctcctatgtggagatgtgcctatgtacacagtggtagcctttcccaggcaaatgtattgaattagaggatgagatggccttgtgatacatagaggagcctcatgagaagagatgtgcctatgtacacagaggtagcctcaccaaaaaggggatgtacctgatatatggatgagatgtacctatatatctagaggagcctccgctagggatacatgtaagagatgtgccgagtatatagatggagcctccctgagaggagatgatcctatatactgcgaggtagcctctgcatgacaattattgatgtgatgaatggcttcatgccatgattatgccttgatgttggctgatagatgagtatagcctgattgtagtcaggattattgagcattgatgtgcctgatgattgaattaacccttcactgatgataatggtgattgtggttgatagagatatatatatatgtatgtgttgtgtattgatgtacactgatgatactgattgtatatatgatgtgatggatggtagttgccattagttagcctgttcgttgacaggtggacatgcattgttgtgcatgagatgtttatgaggtgattcactggtatgttaaattacttatatgtaattgtcagtgaaccaggggaaggaaataccttcaaggaccctgagtttactgagattttatatctcaccccgtttgtgggacttatgatgcaggtgattcctctggaggagcagagagatcccaaggcaagaagcctatgcagggatagctgctgagtgcataccttaggctagatgatatgagcatgtggctctgatgttttgtacctagcctttagatatgttttgttataccctgaggggttatttgtactgttttgtatacgaacagggatatgtatattcaccatattacgtgtacagtgtatctgatgatgacatttgttgatgtcacttttatatgtgcttccaaactgcttacaactctgattgattgtctgattgtatgtgattatgtttggtaatgaccctcacagagaagggggcgttacaactcccgtagtgttcttaaccctttaacccactttaatcccctatttccttagtgatattggttaggtcaagcattaaatgatgcattaaatggttgcaagcatacactcctatccctagttaatgtaaagcttgtccctttacccaagtccaagcatagagccccaatattcctattgtaaaccctagctttcagtacctaactagagtgatcagttccagagagatagaaacatgcattcaacaagataaagtgaaataacttgatattaatgaaagatagcatccaatacaatccaaaagaggttacattcaatgcttagccctaactacaataaggaactagccaaacctcattgtgggtggttgtgttacaaaataaaatggcatacctagctgaagcaaggaagaagaagatggagaaccctccacttgagcctccactctccctaaaccctagttaaggcacccaagcttcctaaaaccctatttagtgttgtttccctccaagaagtcgtgcattgaatgctgaggttcaagcatttatagtgtagcttgtgaagtccctgttttgcccttgacaactttaattacagggcttctgtcgacctgtggcgcccttggcgtgagactggcgttgatggtgccaacttgaagaatgaacgacgctcatggcgctggctgacagagaatgtggcaccccaggcgcggatactggcgctccaggtgctgaagtccagagatggtggcaccccaggggcggaattggcgctcttggcgctaaggtccagaggatatggcactcctggcgccgtgctggcgctcttggcgccaaataccagaacttgtggtgcctttagcacagccttggcgctcttggcgtcagcttccagtacttttgacgctgatggcgccactactggcgctgatggcgctagtgccttcttccaaactttgtcattttcttctgaattttgcttgaccttggcatctttgattgatatcctggaaattcatcacattagctcaaatcatacacaaggagggcacttatccatgctttatgctcaattcttactctaaaaagcttaggaaaaccttatatgctaggcgcatatcatttattttattaaaataaatattttttcaacaaataaatttaaacaaatttaacaaaagaacatcacttgagttacgagcatgagttggaccgattagacacatatcagacaattataaagaatgtttttatggttttgaatctagttggaatactaataagaaagacgtgaaactaaaattccaaagtacaattaacatgatactagctctagatactcatgcttacatgcctccgtccctgattggagatatatgaagtttatatttaatatggataagtccttggaaacacagaataatcgggggtcaatctcaaagtttggaataactataatttcttattaaaatgtcgatctaaatggttcttaacataataagagtggttgtgacatatacttgaagtttgagtttgccagagtctataaatgtgtaatagacactggcaagtgttcggatggaagataaaatctagaacacaagtgtttgtcaaaaaagttaaatggaaagagaagaaatagaagtattggaaaaacctccattgaagccactgcataaaaaacccacttggaagtgtgatcaaatatcagcaacggagataaaaagtaacacaggaaatctgacaagaataatttgttctgaaatttgacaagaatgagagtatagacgcagaaaaagtgaataatgcgattgcatttgtcaatatgctcattggttgggatcaattaatgtcaatgcataacttgattaatcttttaattaccacttcataactattacaagttaattttttaagttaagatcttaaaaataaaaagaattgacctagcttgaaccatgcaagctctctttccatttgaatggttgctctaaaactggacaatgctttgaattcaagtggcagatgagcagctaagtgcagaacgttgttaccttcattgtccactgctcctactatatgctctatctttttaagtatactaaaaaaatgcttatttttcaatatagggcagccaagtgcagtaggtttcgtccattgttggggtcccttatcatggtcactagtttactattatcatcaagaatccaaccaagagcctcatcatttcgatatatagttgattggtccaacaaatgtataacatgagcataaagaaacaagttaaatgaaagtttgatcttatatgacacatcaattttttgacacacataattaaataaataaataaataaataaataaataaataaaacaccattcgcaaccgatcatgaaagcttacttagaatttctgaaggctttcgccccagcatatgcaatgctgttaacttctctttttgcctcttcatctcttgcaacggacaaatcagttggatattttttaaataatttcattgccacatctgttacatgataagctgttagcatatagtagtttttaggataaaataattaagaaattaaagataaaatatcaaataaaggctttaaatagatataaattatcttatcattaattttatcattttaatatttaggaacaataaatagcagaaaagaagcaaaataaagggtaactggaaattgcagctcacgcggaccgcgccaagaccatgccaatcgcgccacactcactgtctgttgacgctgatcacgtgaaactgatgctaaccgcgcggacgttactggaaattcaaaaataagcttaaagataagataagaagataagctcttagggttttgctaacctatctataaataaagaagccacagaactcactcagacgcagagagacactcagaaacacaataaacacatgcggaggctaaagaagcgaagattgagaagaaaatcaagattacagggtttgattattattcttatttgtatttctactcaccttcttcttcatatttgtactaagctagacataattatgtctagctaattcctccttgattgtggtaaaggccaaaaaccaatgtgaactcttgtgtggataggattgatgttaatgaagattattatgattgcttctctttatcttgttcttcaattttaaattccattgatagaattgatcactctattagaggtactaagggctttaattcacaatagggatattgggattttagtttctgaaagcgataaagtgccagtttgacattacctagggatagagatgaaggattgcaaagtttttatatgccagcttaaagcttaatccgaaagggggttactaagggattagaacacttaattaggattaaagggttaaaaagaccgagaaatctgggtttaaccaattaattaaggtgtatctttgagtacttgtagtaattgaaatcaattatcaattcaattaaacaagtagggatcaaaggtgattgtgcttttaccacaattgttcttcctcactgcataactttcttgttaatttaaatttaattctgttttcaatatattccaagttacatcacaaaatcacaaatcaaatttatttctatttttatttcttccaattttaagataataattacaattacattagtgtctcaatcctcgtggagacgatactctacttatgaatttattacttgaacgatcggtacacttgccgtgagttacgcatcactttgtgaagcgacaagtttttggcgccgttgccggggattgagtacgccaatttaattgtaattttattctttaaaattggattttgttttactaatctgtttctttagtttatgcgaggattagcggaacctgaaactttacagtttgacccagaaatagagaagactgcaagaagaaacaagaagctagctaagcaaaaacagagagcagaaaattctaattcacaaactgcagttgaattagagatgactgaaggcaacaacaaccagccaagactgggagatgaattaatggaggacatccttgctccattattttctaaaagatattgtcagaagggtttctgatttaggtggttctgttgtaactagtgatgatcatactgtcactaagaggtttgtggtctgattaatactcatgttactaggaacatgttttttgtgtggtgaattttatttatttattttatattaggaaagatgatgataatgacatccacgaggatcccaagagaaataacaacgtaatatatcaattcagactgagttggcttaaatttttcttttttgactaaaccttctgctgagtaattatctcttgtcatgcagactgaagcttttgctggttacaaaagaatttacttcagttattcgggaaattcacaagttgcttcactgacttgcgaatacaagtatatttaatagtatgtaaaccttactatacaaagaaccaaaactacctggttttcttaaaacttttggtgaaaactgttttgtaattgagcaaactattcactatagaatcagaattaacacataatttggaaattctagctgagagatgcaacattctaaagaacctcgcagcagcttgatgttaaatattatctgaataatgaatttttttttttcttcatgatttgcacagagcctggcattgcagtggcagaggaagggggtatcaatgtcagaagagaagcatgaggaataccctgaatggtcattgtctgatatggaaaaaatgaacattgatcccatgcaactagctaattaacttaaatggaaggattgatgaagatgaagaggattatgatgaagaaatgtagatgaacctgttttggtttagaaagttctaattgagaattagagtagaatttttaggtgtagtattagacaaatccttagtggttaggaagattaggagggctaggacattgaaaactctagtccttacaacctttgttttaggataaaagtggagatatatattgttccaattagaaatagccacggtattgttatttgagaaattttaatctcatataggtctcgcctatggtaggcactacattcagatccttaaacttacggattttgattttgtttcggttgttagctttgattgtggcgttgtgtatgttattgtatcacaccacgtttcctctcgagtacaatttgagagcaaatcggcggagcaaactcactgatccgacgacatgatttgcacttgaaccttctttgttatcttgaatttgatgagaaatcagataaatggaaaagaaataagagagataaaaataaaagtttaatatgtatgtactaacactaacagtataaaacaattttagaattttacaaaccatcatctaattataaattatcattttaaaagttaacaaatttgttatatatacacgatgagttgtgattggatgactatgtaaatctttttaaactctcaatacataactcttatctagaaataaatacaaaataagatgaagaagatgtattatttagattaataaaaataaaaaatatataaatttttatttgtttgaataaataagagagtagaaaaaaaaggtggttattgcaaaaatgtttatacaaataaaaaaataaaatttaatttgaaaacctgaactttttaattattttgttatttctcaacatgaaaatattttcttataaaacaataatttgattttttaaaatttaaacataagtaaaggaacactcctaatcatttctccctctatttcacgtcacttggtgagaaatatgatttggttaggactcattaattataatttcatttctcatattctaacacatttaatcaagaattttttattactttatttatcttcattttaattttatatttattataactttgttgtatatagtaattcttggcagatcgagtaagattaagtctcagtgaaagatgaatgcgtaataaaaaaaagggtttgtctttgttatgatttgcagtatagtctcaaattaaggcgggaacaataagaaaggtaatatttcatgagatagaaaatgtagaataatctcaaatttaaacacaagcttcattgttccacaaacaaataataatacagtgccttaaaacttatgccaatgtctgcagctctgtaataagttagtccagtttgggccaacgataaaatctagaccagaagtgttcgttgaaaaagctaaattgaaagagaagaaacagaagtattgggaaaacccccattgaagccactgcataagaaacccacttggaagtgtgatcaaatatcaaaaaggaggctgcagtgaaagccacaaccaaagcagcaacggcgataataagtaacgcacgcccaaaagtcaagctgggatgtagtgatttcacaaattcgctttctgcgaatcttgatgaagtgaaatttgacaagaatgagagtaaagacgcaaaagaagtgaataatgcgagtgcatttgtcaatatgaagacagtaaaccacgcattggtcttatcacctggaacagtcagtgcagctgcaaatgctacggtagcaacaagtgttgacacaagcatgccagattcggctattcctttggctgtttccttaatttcttcagataacttcttgtgttccttataaaatacattaattggtctcatgcccgctttgtttgtctttgttcttagttcaggaacatttcgcttcactaactatttacaaatcaagagtatatgtaaatgttggtatccaaatgcataacttaaattaatctttcaattatcacttaataactagagcaaattacaacaacacctcctaagatttagagtaattacacaaatattttttgagatattagagtaatttttaaggagatgttagtgtaatattttcaaacatataaaagatgttagtgtaatttttcaaatttaaaagaaattagtgtagaaaaataaaaaatggaattacatataattatatgaaatctcaggaaaattattgtaatttcctcaaatagctattacatattaaatttgtaagtaatacaatttcaaagttaagatatttaaaaaataaattttaggggtgatatttatttttacaaatgcacttgtattatttttaattaaaattttctattatatattggctgtttaactattatgctaaagacaatggataacaaattttaaaaaaatattaaaataatcaacaaatactacatacaatgatttctatttttaattaaaacttgttacttttaaagatttaaaatcagtctagttaacataagcctaaaattagtggaattttaaatttttaaaataagatagctagaactgatcgatcccatgcgagtgaataaagaatggttgaataaagaaaactaagcaaattaattgaccttgaaccattcgagctctctttgcatttgaatgcttgctcttaaactggacaattcttggaattcaccttgtggaagacgcgcaaccaagtgtagaatgttgttacctccatagtccactgctcctcctagatgctcttttaatccccatggtataatattaaatatttcattttgtcgaaatagcacaaccaagtgcagtaggttccatccatttctttggtccctataagtcactaattcaggattcttgtcaataagcatcttcacagcctcaacatctcctgattttattgcattttcacgatcgtgttccaatctttcaacttgagtcgatactactccaaatagtcgatcacaaacgtctgattccttggcaaacattattttgtgttactagaataactcaacaaacatcaaataccattattacactggatagagataattaaggactaattcttaattttttatataaaacaaaaatatatataactttctaaaatcaaaatcaaaatggaaatgatgtcaaataagatctaaattttagcttagaacacacaaaaaataaaaagccattttcaacttgtgaaaggttacctgacattcctctaggcttttcctccagcatcttcactgctgcaacgtcctcttcatttcttgtaatggccaaaacagttggataattttcaaataatcgccatgcccaatctgttatacgcacaaattaaatagtacaaggcaaggtaaataaaattaactacaactaaattgaaaaaccacgtacgagttcatatatatctccttttatataaatgaaatcaatgagaatttagctaggagctgtttggttttaaaggatgatatcacagtctttcagaaacctaatagtcataattaattatttcaactgattcaatgggttcgattcagtttgtaaaacttcataatatgtaaaaaagagaactagattacaaaaaggagaaataagtacataagagaactagattaccaaaaggagaaataaggttgtttaattagttttacacttaccaaacatgtcgaacctaatggtcatcataaacagtcgttcaatatccttcaaatcaatcactacatcaagcaggaaattaatgtcttctggcttcatacgcttagccaacactttcacaatttcaagaatgcctctctttaatgctagatgaatagctatgtctccacttgagtttggtattagcatgtcttctggcctcatacgcttaaccaactcattcacaaaatcatagctggattcccttgctgctatatgaagagctgtgtctccacttgagttttctattagcatgtcttctggcctcatacggttaaccaactcattcacaatttcaagaatgcctctctttactgcttgatgaagagctgtgtctcgacttgagttttgtattagcatgtcttctggccacatacgcttaaccaactctttcacaatttcaaggctgccgtaacctactgctagatgaagagctgtgtttccatctgagttttgtattagcatgtcgtctggcctcatacgcttaaccaactctctcacaatttcacccctgccttcacttgctgctagatgaagagctgtgtctccacttgagtttggtattagcatgtcttctggcctcatacgcttaaccaactcattcacaatttcaagactgcttttacgtgctgctacatgaagagctgtgtctccaaaatattttaacggaaagcgtaccatatcaggacatttatcaataatcgattttgattcgagccactcattcctccacatatgtctcgtcagatcttctattaaagaacctgcaatactttcaaacttcacattataacatgtcctttatataataatcataacgtacttttagtatttagttgcaaagaagaccattttaatttctcgtttacccttaatctgtaaaaattctcttggaaactcgcctcaaattttgaattcctaataatttcatcagttgtaaattgaaatctaccagagaaattcgagattacgtagtcgaagggatccaatcatcaatcacctttaattaagtttgaacattgaatttcaatttgtgtttgaaaattaattctatgatgatgagtaaaagtgtttttgagagaagtcatttattttttcttttcttcagttgacaaaagctaattgatcttaacatgcgacttatttatcctcagtttaaaagtgattctacttttttttatctttcaaataaaaaataataattttctaaacccattgttgaaatatcattcgtataataatagtataaatatatttttcttaaagtcaggggtttcaaattcaattttttcaaatggtaaaaaataaacaaactcttaagacatgatctctgaaatacaccctactgtgaatgcaatagtttcaagtataacttactcagctcttctggagtcatttcattcacttctatactttcatgttttggtgccagtgagtttgttgaagtggcaattggagtttgctcatcaatttgaataggagtatgatctggtggaatctgaattatgtggtcttctgaaacttcggtagtggagttcatgatttaattctagggaaaatgaagtgatttggatacctctctaaaattccgtgttacttctttctttccagcctgagaagcttaacatattatatatggtggtaaaacaagagcccttaattaattatttttccaacttgcacttaaaataactatttccgatgtgacattttgtggattatagctatgttaattgaatctgttcaacatttcaaccccacagttttcaaaagctttttaagttgaatgatttctaaatttatataatattaattcatttttaaagtgaataagtatattcattaaatttgttaacagaaaaaaatattcattataaaaaaaattatattcattaaattgtgtggattagcgagactcgctatcaagacaccatgttaattaacttactctcaatttaaaattatatttcttcgttgtacaatgatatgatatctttacacacctaaaaccttcgatttcctactcttatattgttgacgaaaactttctgccatagcggtggttatatatttatccaacttccgttgacgcatttaattatatgattatatcctaactctggtctttttatactagttataatcaattactccaacaaccattgaactcaaagctaagactagatgcattttattatcggaatatgtataaatttattaaactcactccaacaaccattgaattcaaagcaagactaaaagatagttacccacgtacattttgattgttatgttggtaattgttgttatgatattttttttatgtatgttttttttattaatgataacatacaaaaggtaacggattgatgatattgaataggagtatgatctggggttggtataaactgaattatgtggtcatctgtaacttcgatgttggagttcatgatttaattctatggaaaatgaagtgaattggatatctctatgaaattccctgttcgatcagtgttgcttctttctttccagcctgcgaagcttgaacatattatatacgatggtaaaacaatagcccttaattagttttccaacttgcacttaaaaataattattcccaatatttttcttccttgtacaatgatataatatctaaatatttttagtgttagttcttgaatttaagatttgattttcactaaattttttaataaataaagtgaatatattttcaatataaagaataaattcttggagaagaattctaaagatgcactatatatatgttaaaaaaagaatagttttttttcttcgtttatctcccctagctaagatcttaaaatgagatctatcattatataaaaaatagaagagatcttgagagattttcaatcttccatgacactatggagtccaccaaaaagtgatctaagatccaaatttggcatgtatcactaaagatgaacaatgatattaaattcaagatccggtcttcactagatttttcaataaaggagataaacacatattcaacatgaagaatgaatttttgtagaataatccttaagatctacacaatattcaaataataataattttttcttctctctccctaatatttcaaaataagatttaccactaaagaaaagaatacaaaagatattaagagatattcagtcttacttgacactatagggtctactaagaagtggtctaagatcccaatttgggatctaccactaaagatgtaagcatctttagtgttagatcttaagcaaggatcttgagttcaagatttgatcttcactagatctcccaataatagaagtgaacagatctctaagcatgaagaatgagttcttataaaataacctcgaagatatgtacagtattcaaaaaagaataatcttttatcctctattttcctctcctaagatttaaaaatgagaattactattaaagaaaaaaatagaagagatctccataaatatttaatcctatgtgatactatggggttcaccaaaaagtgacataagaacatctttagtggtagatcccaaattgagatctttagaccactttttggtagacccataatgccatatgattaaatatttcttacattttttctttagtaataaatcttatcttgagatatcaagaagagagatgaaaaaattattcttttttaaatattgtgtatgttttgagggtttttttttataataattcattcgttagtatgaaaatctatttattttctttgttagaaaatctagtaaagatcatatgtgaactcaaaattcttgtttaagattttacattaaaaatattctaagatatcaattaaaaacctacttaaatatgtttattgttgacgaaaactttcttccatagttgggattatatatttattatatattttccttccctaagatttcaaaatgagatttactattaaaaaaaaatagaagagatagtgatattatggggttcacaaaaaagtgacataagaacatctttagtgatagatttcaaattgaaatctttaaaccactttttgatagatccatagtgccatatgcttaattatatcttttacatttattttgagtgataaatctcatcttgagatatcaagaagagagatgaaaaaaattattttttttaaatattgtgtatgtcttgaagattcttttataataattcattcgttaggttgaaaatctatttactttttttattagaaaatttaataaagatcatatttgaactcaaaattcttgtttaaaatcttacattaaaaatattgtaagatctctggttattgttgacgaaaactttttgccatagctgtggttatatatttattatatatttatctaccttcccttgacgcatttaattctttgattatatcctaactctggtctttttatactagttatagtcaactatgccaacaaccattgaattacaagatgcattttattattggaaaatgtatgaattttattaaacccactacaacaaccattgaattcaacgcaacactagaaaaatatttatttaatattttggtgaaatttattcagccattcatattaataattatttttaacattttaatccttttatgttaagtaacataaatttttttattaataataacaaacaaaaattaacaaataaatacatttatcatattttttctttcaataatttaaatttaaatttttatatttaaaaaataaatttatcaataaattacacatttaaaaacaaaaataattatttatccaacacatttttataaaatttagaaagagccaggctataacaggagaggagagtgtaatcaatcacttattatgagaaagtattttatgaccatcagattaacttgtttaaaagtcaatgattgtaaaattttattcttttattataatcttttcttttttgtcgtcctctttctcatactacccttttcctcttctcttctttcccattcttcctctcttcatcttaacggcaacgatggtgccatgacggccggtgatagtggggatgatgcgtcattgcctggccgttgtgcggagtaaactagagagaactcgagagggtctttcgccgtttttcttgtggtgttctgcaacaagatttaaaccggagaaaaatcatggaagacaaaacagtcacaaagttttatataactatcgcctcacttaaacccaaattggattcaattgaccagattttagtctcccaaagttttgagctttttgatatttgttgtgtacgtgtttattttttctcataggtgccaactgtcaagttacgagtttgtttattgcataaacgttgtttctataccattgtactctcaattttgagtccaatttgggagaataaaagacctaagattttggttttgaaaatcagacgacattttttatgacgatttgtgattatatttgaaattgcagtttcaaggaaattattgtactattgatctgtaatatttgcaatctggcagtgttttctatgttcagatatgagatgggtggtggtgcttggtggtggctccaccaccgtagtgaccatatgtggatgtggaatagggaaaaaggaggaaaggtaggggttgccgaaaattgctttctgcgtaggtgttgttgtcgcaggcaagaaaatggaaggaaggcgaaaaaaatgaaatgttgccgacttgccgccagaggtgatttttggcaatggcgcataatggttaacgacaatagtgatgaataagtcagagggataaattaggaaactcaagaagaaaaggaaaaaaaataaagaaaaaagaagaaaaaaattcatccatgggtttgaaatttgataaatctaatgatgaaaatttactttacaattatgggagacctattacactctctcactctagtgtgtgtcagaataggaattaaattgtacattatgaaagatttaagactaaaaataatattcaaagaaagtacaaagtctaaacatatattttaaccaaaatattagttgtttgagagttgacaccgtgtttcatactaaattatcccatgtgcaagatataactatatatgtaagatttaggatttaaatcaaggataataagaaccctaaatcctaaattataaaccccatggaaagtaaaagactttgacaaggtgtatgtgtagtttacgaaaaagataatatgaattaattacagtgtgtttgaattttggctttaaaattatgaatgaacataatgacatgagtcaaacttgattttatcaaaaactagttaaatgattcatgacttgcatagtagtaattttacaatttataatttcttacaatattataactttttaagataacatttattattattattattattattattattattattattattattattattattattatnnnnnnnnnnattaaataaaagagaaatcatatgaatatatatatttagaagagagagaaacattaataataatagtatttttgaaaacatattattttagaacaaatttattattatcaacttaattaattatttttaatcttgatgaattagataattgaatcttataaatagatatggaggtactatataatataatagatagtagattttgcatgtttagttattttaaataatcaaatttaactgaaaaaaattatgatggagttgaagtaggaataataatttctacttctaccaaaataacttatagttagattttgtctaatttactttcacatcaatactctcatatgcatctatatgttttttttattgatttaaaaacataattaaaattcttcctatatttatagattgtaattgttatatttttttattgaatgcattttatctaacttatttttgtactcataaccataatatatatatatatatatatatatatatatatataacaaaataactatttgtaatagaaaatcagtgtatgtggacattcaaatccattttgatcattacaccatcaaaatcaatttaattcaaacaatagtctctcttaataaatccattttcagatgttgatggagtatggtttgaccctccgaagtattttactaatcttttcatcaatgatattttagagtgaatgttatggtgctaatgagattggggtgtcaatagaattgagagatgaatcccattagctagactttgctccccgtttcttaaaaaaatcatttttaataactattatccaaacaaaaattacattattatataatcaattctaaccataattaactatgtaaaaccattttggtgcccgcctttaagcatattctacattcatcttctatttccaaatcgacattgcttagttttccatctccttcaatcatcttcttgccttgacttgaaccatctacctatagttgttggagagcaacaacttaatttcttacaaatctccaatttctccgcgctaccatgaagttgttggagagcaacaacaaacaagtgtcaattacaaacattggcaaactgcaaacctatacaaaagcagaaaaagaactgaacaaaaacaattttcttgaatgaatcaacaggttaatattaattaaatatccatccaagagcttattttgaaacttttatacattatgatgcccgagtaaatccataaaattaagcttttcacaaccattaaatccatttacaaatcatggctacatctttgaaaattggattacctgttttttctaattgtatgtgcttgtttgctcttccactttctccgtatagactacgaatgttacagtagaacatgagtagcaatatagagataaataaatgcaaactaactaaatgataggataaaacaaaacaagagagatcaaatttaaagtattgtgtttgtttgaggaagatattctcacacgaggttgcaaccactattagaaaaaacgtcttcaaattggacaattcaactactaaactgctcaaataacatgtctgaatgtctgatcagcaggctactggatcgatttgcaattggtctgtagactatcttttagtttctttctgttcacaaactcttttttagcttagcaaaacttgaaactaattttggtttagtttggttcacaggaacaatttggtgcaatctctctgttttggttcagagcaccaatcgattcaaagctcaaagcccaagtatagaagtaaattgtatgcacttgtgtgaattgtccatgcctttctttaatttgctgacataaggggattagagcttatcattagcaaaaaagggtttatcgtccgaggaattgaagtttagctaaataagagaaattgaatcacataattaagacgaccaagagattatcttagggtggaatcaagggaatttcaacttacacctaaccatttttattaattgatttttctagtgcattcaattgtgctcttgtttctttcaattaaataaaaaaaaagtccaaaaattccaaattgtttatctcttaaatcaaaagagtaatcgataatttcatttattgtattgttgataaaccaaatttgtttattgatacaataatttctccttatttaatcaattgtacaactagtacacttgtcgtattctcaacaaactacaacaatatattggtagaaggtgactcagttgatctttaagtcactttacgtgaagtccacattgcccacagtaggactagtgttagaaaacatcacacttcagagtaaagccttcaatttaatttccatagaactaaacgtgatggaaataaagttagtagaaccgtagaaatatagatgacacaatttgtttgatgttaattaatgtaaatgtacttcttctcttgatattcaataaatatgcatgttgtcatcgttaaaaaataaaaagatgagctattttttagtttctaaatttttaaatttatctttttagtctttgaattttttatttatatttttaatctcttaatttttttctcatccttatttttagttctttaaattttttcatccttattttagatccttttaaggaactgaaactaaatatgaaaaaaagttaaaagactaaaattcagaacaggaaaaacgttaaagaattaaaaacatataaaaagagtgttaacttacaatcataatatatttttaattttttatactaaaacaaaaaaatataactttggaataacttatttatagtttatttaaaactactaactactattaccgctactaattgctattaaaagaagtaaaaagaaattaaagaaatcttataatcttatttgaaatattgaatatttggtgagatgttaacgtaaaaatataaaaaggtgatcaaccacattaaattaatatctttaacatttctaattgtgatattgtttgtatatatgtttttatcatgtgaactcacgaaaagaaacagcctcagaaaagatagggtgtcatccaatacggatatggataaaactatttacgatttagggttttaccatatagaaattttatacccgaatttctagtgacctgtcttattaaattggatgatgcattcctgtgtttatcactttattcgatctaaattcctctctggaaattaatgaaaaaagaggtccttgactgtttgggcaaatcctcgcgagggaactttatttgttgaagtatgtatttcatttttgtttgcttggaactataataacatatccgtagagagagtctcacaaatgatttttaaggcagcatggcacttcaccaaaggttcattccattggtggagtcatcacaccctcaaatacactctttttatcccaccctctttcattgttccatttcatcttattttttaacttcgtcctcattgatcctcactcaacctctttgccaaagaataaaataaagtggcaagttacttgataggcatagggatagacaattttttgttcataaacatataaataataaaataaaataaaaacttagtaatgattgtgtaatcttattgaattgattattggcaggctaggattaagaaaattatgcaagctgacgaggatgtagggaagattgcaatggctgtgcctcttctagtttgtaagtaatctttctctttcatgcatattctagggtgttttccttcttctgttgaaaaatgatttttttttttttattgtgcttttgggagtttctataaattatctctgatttatgattatttgtgtttatgtattgcaactaaagcactagagttatttctgcaagatttgtatgatcgaacatgtgagataactttgaggaggagggcaaggactatggacgcttttcattttgtaagtgaagtttctattattttcttggttcaaatttttgtctatgtgaagtctgttcaaggtggtcacaacaaggctgcaggtttctttcttttggagggcggctattactatgtacttataagaacatcagatctgcaattctaatgataatgtgcacagtctcaaacaatttccttcttgtgccttctatttatcacatgcccaaacatgattagacatgtaaatgacgtctgccagaagaaaatgttgggatggtcttgcttttggaaaatgttttttgttctagtgtttaccttcactttccagtttctaaaatgtctgagttacttgcatccttctgttgcaactggtgatgaccatgctgtcactaagaggaggtttgtgctctggttaatactcttgttacttggaacaggttttctgtatgctgaactttgtttactttatattaggaaagttgccggagatgatgatagtgacagcgacgaggagctcaagagaaataagaaggtaattcataaactgttcaattacttcatcagttgttagcttaaatttttcttgtgtgattgaaccttttgctgagtaattatctcttgtccatgcacactgtgaaccttttgctggatacaaaaaaatttacttcagtcaattgggaaactcactagtggcttgtgaatgcaagtacgtctaaatgtctaatagtctgtgaggctaggccccacttcaccttaaagcttactacacaaaggaccaaaactgtctggttttctgaaaactctatagaattggtactaaagaacctggcagctgtttaatattaaatattatctgagttatggaacttttttttttcgtccatgatttgcacagccagagcctggacataacagtggcagaggaaggggtaggggcagaggtaggggtaggggctgtagattaagagatgagttcacatgccaaatgggaagatgattctgatgtattgaagcagaatgacaaccacactcaaagcaatgaaagcatggaaaatgtgccggaaccagaagtagttaagcaaagttttccagtaagcaaactggctgaagtgtccattctaaattttgacttaaatttggacccggatgaggatatggattcattagacacaccaacttctgtcccaactagttcatctgcaaaatcaatgtcaaaagaaaagcatgaggaataccctggatggtccttgtctgaaatggaaaaaatgaccattgatcccattcaactagccaacataaatggaaggattgatgaagatgaagaggattatgatgaagaaatgtagatgaacctgtgttggtttattcattacttctcatataggcccgtcattagaatgttcttatggggaattagagtagattttgtaggagcagtgttagatactccttagtagtttaggaagattaggagggatagggcattgaattgaatactctccttataacccttgttttaggttaaaagtggagatatagattgttccaattagaaatagccacttgccagtatagttatgacttatgagaaattttaatctcatgtaggtattgcttatggtaggcactacattcagattttgggtgtgttatggctcaaaattttacggggatgcctatcttaatcacgcttgtatctagcggaactaactcactgctccggcaacatgatttgcatgcaaccttttgaacttttggtatcttgaacttgttgcatgatgatacaagaggaaaagaataagacgttagacggatagaaataaatacgaaataaagtaaaaaagatgtgttatttatatgaataaaaatagaaaggaaatgtgtacaaattcattgtttatgtttgtttaggacaaatgaaagagaaaatacaaacagatgaattgttttaaaaaaagaatacattttttttaaattatttccattattttttattatataacatacgtatttgttttttaatatataagcaccactaatcgctgccctgtaaaaccaatctcgcttcaaactagtttgttcaaacttaaaataagtattttttaaataagcatctatttaataaacaaataaggttgatcaaatattcaaaataagcagaaaaaatgttttttaagcataaacataaagaatgatttgaataattaactactcaatgagggacttgtgcctaccatgaggtgaacgttatctaaggtggaacataaagaatgttcttatggttttgaatctacttggaatactaataagaaagaggtgaaactaaaattccaaagtacagttaacttggtcctagctctagatagatccacatgcttacatgcctcagtccctgattggagatatatgaagtttatatttaatatggataagtcctaggaaacacagaatagccggggctcaatctcaaagtttggaataactataatttcttattaaaatgctgatctaaatggttcttaataacagtggttgtgagttgtgacatatacttgctcccttcaccaaccacagggaaaacccccattgaaaagccaccgcataagaaaccaacttggaagtgtgatcaaatatcagaaaggaggctgcagtaaaagctacaaccatagcagcaatggagataaaaagtaacacaggctgcagtaaactcgctttctgcaaatcttgatgaactgaaatttgacaagaatgagagtatagatgcagaagaagtcaataatgcgactgcatttgtcaataagctcattggttgggatcaattaatgtcaatgcataacttaattaatcttttaattaccacttaataactattagaagttaatttttttaagttatgatattaaaaataaaaggaattgacctagcttgaaccatgcgagctctctttgcatttgattggttgctctaaaactggacaatgctttgaattcaagtggcagatgagcagctaagtgtagaacgttgttatcttcattttccactgctcctactatatgttctatctttttaagtatactaaaaaaaatgcttatatttcgatatagggcagccaagtgcagtaggttccgtccattgttggggtcccttatcatggtcactagttcactatattatcgtcaagaatccaactaagagcctcatcatttcgatatatagttgattggtccaacaaatgtataacatgagcataaagaaacaagttaaattaaagtttggtccaatgtgaaacatcattgttttgacacacgcacataattaaataaataaataaaacaccatttgcaaccgatcatgaaagcttacttagaatttctgacggctttcgtgccagcatatgcaatgttgttaacttctctttttgcctcttcatctcttgcaatggccaaatcagttggatatttttcaaataatttcattgctacatctgttacatgaacaaattaaatagcgatggtggattgcatatctacaaggctgggtaaaactccaactaaattggtaaaccacgtacgagttcaactagataaaaaaaagggatgtttggttttacacttaccaaacatgttgctgctaatggtcataaaaaacagtctttgaatatccttataaaccattttgtgaagcagattgagaggacaaaatttgcaccattttgttggggccatataaaacaggcaagcgaactggaagcatcccatctgagtttggtatcagcctagaacgattggatctgaaaattctaatgataatgtgctcagtctcattaaatttccctcttttgccttttatttttcacatgcacaaacatgattatacgtgtaaatgacatctacagaagaaaattaaatgttgggatggtcttgcttttggaacatgtgttgtttgttctggtgtttaccttcactctagtttctaaaatgtctgagttacttgcatccttgcctttgtagaaaacagtgagtgcagacttttaatgtccttgattttctaaaagatattgtcagcaggttttctgatttaggtggttcagttgcaactggcgatgacaatactgtcactaagaggtttgtgctctgattaatactcatgttacttggaacatgttttctgtgtggtgaattttgtttattttatattagggaagatgatgataatgacagccacgaggagcccaagagaaataacaaggtaatatatcaattacttgtcagtagttagcttaaatttttcttgtgtgattaaaccttctgctgagtaattatctcttgtctatgcagactgtgaagcttttgctggttacaaaagaatttacttcagtcattcgggaaattcacaagttgcttcactgaggtgcgaatacaagtacatttaatggtctgtaaaacttactatacaaagaaccaaaactatctggttttcttaaaacttttggtgaaaaatgttgttgtaattgagcaaactattcactatagaatcagcactagcacataatgtggaaattctagctgatgttaggtaccagagtgacgaagtgataacacacacagctaaaataagagatgagaaaaggagaaatggacacacaaatttatagtagaaaaccctcaacaaataagggaaaaaccaagggacaagaacagaagaattttcactaagtggaagaaatttccacacctctctctaaaataaggagagtacaaatttaccactctctcttatactaggagaatacactctcactcactctagctattgaagaacacttggtaattctcaagtgtggggatgcataaaacgaatgccaagcgctcctttatataggagttacaaaacgcgtgtgcacagtaaaaagttactgtgcactttgaaaattttgcctaaactttcggtgtgcacagtaaaaagttactgtgcactttttgaaaaaatgcgcattcggtgcacacggtttcaacaaatctcccacttggagatatgattgagaatcaatcaatctccacacagttctttctatcttgccagttccatgctgtttatgtctccgataggccatacgaggatcgacaccatatgaacttgtcagcattgattggttttgtcatgacatctgctaggttatctttggtgtgtatcttctgcatgtccacacaaccttcctctactacttctctgacaaagtggtattgaactcctatgtgcttcgtcctagaatgaaaggctggatttcttgcaatgtgcaaggcactctgactatcacaatacacaatcactgattgctgtttgtgtccaagttcttccaataacctttgaatccaaattgcctctttgcaagcctgagtagctgccatgtattcagtttctgtagtagacaaagccaccacagtctgtaactttgataaccagcttactgctcctcctgcaagagtaaacacatagcctgtagtagatttccttttatcaagatcacctgcaaaatctgaatcaacatatcctctgacagtaaactccgatccttcataacataatgcagcatctgaggttcccttgatgtatctcaagatcctcttaacagctttccaatgctctctaccaggatttgccatgaatcgactgaccataccaactgcttgagcaatatccagtctcgtacaaatcattgcatacatgaggcttcccactgctgatgcatacggtactcgagacatttccatcctctccgcttcattgctaggacacatacttgaggataatttataattgacaggaagtggggtagaaattgacttacaatcttgcatattgaagcgccgcaagattttcctcagataattcttctggctaagccaaatcttcctatcttttatgtctcggtaaatttgcatccctaaaatcttgtttgctggtcccaaatccttcatatcaaattccctagccagttgtgccttcaactcttggatccgatctttgttggggcctaccaccaacatgtcatccacgtacaatagcaaaatgatgtaatcattatcaccaaacctcttgtaataagtacaagggtctgaattgagtctattgtacccgaggcaaactatgaaggaatcaaatctcttgtaccaacatctcggcgcctgctttaaaccgtacagagatttggtcaacctgcaaaccaagttttctttgcctttttcctcaaatccttctggttggagcatgtagatttcttcttcaagttctccatgaagaaaggcagtttttacatctaactgctcaagatgtaaactgaatgcagcacacatagcgagaactactctgatagtggtaagtctaacaactggagaaaatatctcattgaaatcaataccttccttttgagcatatcctttaaccaccagtcttgcacgatatcgctccacctgattgttgccgtctcgtttgatcttatagacccatttgttaccaatggcttttcgaccttctggaagagcaacaagttcccatgtcttatttctatgtagagcttccatttcttcctgcattgctgccatccacaaagaagcatctggattactcacagcttcatggaatgttgatggttctccttcttctgtaagaaggcagtatgcatcatggcttgccataacatagtctgagtgccacgatggttctcttgttcgtcgcactgatcgtcgaacttctgcatcctcggcctcagttggttcttgttcctcgtgctctggctcagcttcataggaatcatcttctccgttgttcccatctatctctacagtagtaacttccttcgaagtgctgtcatcttcttgttccctttgcagttcattttttgcaaatagtacatctctgctgaccacaaccttgcgggcagtgggatcccacaggcgataccccttaactccgtcagcatatcccaagaatatacatttcctggatttcggatccagcttggttctttcttgggagttgtacattacatatgcgggacatccgaacacatacaaagaagaataatttggtggcttaccatgccacatctccattggtgtcttcaacccaatagccgttgatggcgatcggtttatcacgtaacaggcggtcttgactgcttctgcccagaatgacttggctaaattagcagttctcaacatagctcttgttctttccaacagagtcctgttcatccgctctgctacaccattttgctgaggggtatatgcagttgtgaattgccttttaataccctctcgcttgcaaaatgaaagaaattcaccatctatatattctcctccgttgtctgtcctcaaacacttgatctttctcccagattcaagttctacttctgctttgaagtctttgaaagtttggaatacatctgacttcttcttgattgggtacacccataatctcctggagtagtcatcaatgaatgatacaaaatactttgctcctcctagggacatttctggtgactcccacacatcagaatgaatcaagtctaatatgtgtttgctcctagcagttgatgtggcaaacttcaatctactctgcttactggtaacacagtgctcacagaaagacaggtttaccgacttgagcccctgaagaagattacgctccgcaagaatcttcaagcctcgttctgacatgtggcttagtttgagatgccacatcattgttaattcttcttgactggctgaagcgacaaatgtatctccttcttgcagcgtatctgccataagcatgtagaggtttgatgctatcttctctgccttcatcaccactagagcaccttcacaacctttaagatccctccttcaataagcgtcttgcacccgagatcatctaattgtccaatcgacattagattctttttcaaacccttcacatgtcgtaccccttgaattgtgcgaacaataccatcatacatttttatcttgatggtaccaactccggcaatttctaaggcatgattatttcccatgtacacagatccttcagagacaggcttgtaggtgcaaaaccagtctcgtcgtggagtcatgtgccacgttgctcctgaatccactatccaaacatcagtgagctcttttttgcctttagaactaattgctacttcgctgaataaaatttctccttcaccagaggtactagcaacacatccttgagaagtacttgcttcattagacttctctgtactcttcttattactccaacaatctttcttgaagtgccctttcttgccacattggtagcattttacattcttccttcttcttgactttgatctactctgatattgactcccactcgagccacgttccattgatcttcctctcgtcatcattaaagcttctgcttgctttgaactctccaatctgtcatccttattcttccgtcttgattcttcttcaagaattgccgcagcagtatcattgaatgacagattgtctgagaaacctttatttgtgatgttgatgatgagctgatcatatgaatcaggtagactttgaagtagaatctcagcacgttcactttctgcgatgttgtgatccaacgctgatagttgggaaaacaacgtattcagattgttgatgtggtccgtcaccgaagtagactcactcattcgaagagtatagagtcttcttttcaagaatattttattgtgaagtgatttaacctcgtacaacttggtgagcacatcccaaatttcttttgccgtcttctgttcagcaacacttgacaacactgaatccgccaatgctaagtgcaaattggcaacagcgttgttatccatttctttccacttgtcatcagttacccctgtgggtctgccttcaattgcagctaagcaattatccttcctcagaattgcctttatcttcagcttccacagggagaaattactcccgttgaacttctcaatctcaaattttgctgccattatgttgacgatactctgaataataactgcgccgggtcacactatttttctgtgaatagtgtcgtatacgtgaatagtaccgtacgtatatgtgaatagtaccgtgagagacaaactggaacagtgatcgtagtttgtaaaatagtacaccaggtaagttcccaggaaagagaggtgggttacaaatggacactcttaaataccaagtctttccttagccagaacttttcctagacatgcacttttcacactaccacactttatttccagcaacaagaataattcttttctgatgtggaagatcagacaaactgcaaccacagagcatactaagaattttcttatgaacctggcacctcctcactttgttgcagcagcggaatagtgaccacgaaccaatagctctaataccgctgttaggaaccagagtgacgaagtgataacacacacagctaaaataagagatgagaaaaggagaaatggacacacaaatttatagtagaaaaccctcaacaaataagggaaaaaccaagggacaagaacagaagaattttcactaagtggaagaaatttccacacctctctctaaaataaggagagtacaaatttaccactctctcttatactaggagaatacactctcactcactctagctattgaagaacacttggtaattctcaagtgtggggatgcataaaacgaatgccaagcgctcctttatataggagttacaaaacgcgtgtgcacagtaaaaagttactgtgcactttgaaaattttgcctaaactttcggtgtgcacagtaaaaagttactgtgcactttttgaaaaaatgcgcattcggtgcacacggtttcaacagctgagagatgcaacattctaaagaaccttgcagcagcttgatgttaaatattatcagaataatgaaatgtttttttttttttcatgatttgcacagagcctggacattgcagtggcagaggaagggggtatcgatgtctgatatggaaaaaatgaacattgctcccatgcagctagttgattaacttaaatggaaggattgatgaagatgaagaggattatgatgaagaaatgtagatgaacctgttttggtttagaaagttctaattgagaactagagtagaatgtttaggagtagtattgtacaaatccttagtggttaggaagattaggatggacaggacattgaaaactttagtccttacaatcgttgttttaggataaaagtggagatatagattgttcctgttagaaatagccaaagtattgttatttgagaaattttaatctcatataggtcttgcctatggtaggcgctacattcagatccttacactacttacggattttgattttgtttggattgttagctttgattgtggcgttgtgtatgtaagtctgttattgtatcacatgacgtttcctatcgagtacaatttgagagagcaaatctgcggagcaaactcgctgatccgacgacttaataatgatttgcacttgatgagaaatcagataattaaatggaaaagaaataagagggatagaaataaaagtttaatatctatgtataaaacagttttaggattttacaaattatcattccatcacaaattattattttaaaagtcaacaaatttattatacataaaattgtgattggatgattatataattttttttatattctcaatgcataactcttttctagaaataaacacaaaataagatgaaaaagatgtattacatagatgaatagaaataacaagaaaaaatgtaaatttttatttgtttaaataaataagagagtagaaaacaaaaatatgatcattgcaaaaatgttcatagaaataaaaaatcaaatttaatttgaaaaccctgaactttttatttcattatttatcaacataaaaatattgttataaaacaataatttgatttttttaaatttaaacataagtaaaagaacaatgctaacaatttctccctccatttcacgtctcttaatgagaaatatggtttggttaggactcattaattataatttcatttctcattttctaacacattcaatcaagaatattttctttattacttatttctcttcattttaattttatacttattataattttgttgtatataataattccttttaaattgattaagattaagtctcaatgaaagatgaatttataacaaaaaaaaaactttttatgtgatatgatttgctcccttcaccaatccacatggaaggaaggggaaaagctttgacgtgggttatgcagaatagtctcaaattaaggcgggaacaataagaaagggaatatttcatgagatagaaaatgtagaataatctcaaatttaaacacaagcttcattgttccacaaacaaataataatacagtgccttaaagttatgccaatgtctgtaattctgtaataagttaactagtcctgtttggacaaacgataaaatctagaccacaagtgtttgtcgaaaaagttaaattgaaagagaagaaacagaagtattggaaaaagccccattgaagccactgcataagaaacccacttggaagtgtgatcaaatatcaaaaaggaggctgcagtgaaagccacaaccatagcagcaacggagataataagtaaccatcgcccaaaagtcaagctgggatgtagtgatatcacaaattcgctttgtgcgaatcttgatgaagtgaaatttgacaagaatgagactaaagacgcagaagaagtgaataatgcgactgcatttgtcaatatgaagacagtaaaccacgcattggtcttatcacctggaacagtgagagcagccgcaaatgctacggtagcaacaagtgttgacacaagcatgccagattcggctattcctttggctgtttccttaatttcttcggataacttcttgtgttcatcataaaatacatcaattggcgtcttgcccattttgtttctcattgctcttagttcacgaggaacattcgactccacccactatttacaaatcaagagtatatgtaaatgatggtatccaattgcataacttaattaatctttcaattgtcacttaattaataactagagcaaattccagcaatacctcctaaaatttagtgtaattacacaaatatatatatatatatatatatatatatatatatatattctcaggtataagcttaaaatttgaagaaatgttagtgtaatattttcaaacatataagaaatgttggtgtaatttttcaaacttaaaaggagttagtataagaaaataaaaaaaatggaattacatatgactacacgaaactggagaacaattattgtaatttgctctaatgactattagatattaaatttgtaagaaatacaatttcaaagttaagatattttaaaaataaatcttacgggtgatatttattgttacaaatgcacgtgtataatttttaattaaaattttctatccatatattggctgtttaactattatgctaaagacaatggataacaaattttaaaaattattacaataatcaacaaatactacatacaatgatttctatttttaattaatacttgttacttttaaagatttaaaatcagtctagttaataaaagcctaaaatttgtggaattttaaaaattttaaaataagattgctagaaccgatggatcccatgcgagtgaataaaaatggttgaataagaaaaaataagcaaattaattgaccttgaaccatcggagctccctttgcatttgaaagcttgctcttaaattggacaaatcttcgaattcaactggtggaagatgcgcagccaagtgtagaatgttgttactttcattgtccacttctcgtactatatgctcttctaatttcgatagtatcctattaaatattcttcttcgtcgaaatagcacagccaagtgcagtaggttccgtccattttcggggtcctttattctcactaattcaggctgagtgctaataataaagctcacatccacatcaacatttcctgattttattgcatcaaacagcactgacgaaggattagttatctcgtctatcatccgcttatgttccaattggttaacttgactccataagtcttcaaatagccaacgaccttctggtccctcgccctccatgtctagtaagaggtctatatatagttgattggtccaaccaatatttaacatgaaatgaaacaaacaaaacttaaatttaaattttattcttatatataagaagcaccattttttatctctatttaaaaaattatatattttaatccgtacatgaaaaaaaattgtaagatatttttgcacatctggctcatgtgttgccaaacattaatttgtgttattagaataactcaacaaacatctaataccattattacactggatatagatatttaaggactaattcttaattttttttatataaaacaattatatataactttctaaaataagaatcaaaatggaaattaatgatgtcaaataagacctaaattttagcttagcacacacacacaaaaataaaaagccattttcaacatgcgaaagcttacctaatttttttggaggctttcgcgccatcatatgcaatgctgtaaggttctctttatttcttgcaatggccagagtagtagttggatgtttttcaaatattcgcattgccaaatctgttatatgcacaaattaagtaaaactccaactaaactgaaaaaccacgtacttagttcatatgtatctccttttatatatctgttatatgcacaaattaagtaaaactccaaccaaatctgtctcgacgtattgctacatgaaaagctgtgtctccacttgagttttgtgttagcatgtcttctggcctcatacggttaaccaactcattcacaatatcatcgttggattcccttgctgctacatgaagagctgtgtctccacttgagttttgtattagcatgtcttctggcctcatacggttaaccaactcattcacaatatcatcgttggattcccttgctgctacatgaagagctgtgtctccacttgagttttgtattagcatgtcttctggtctcatacgcttaaccaactcttttactttttcaagactgtcttcacttgctgctacatgaagagctgtgtctccatctgagtttggtattagcatgtcttctggcctcatacggttaaccaactctttcacaatttcaagactgcctctctttactgctagacgaagagctgtgtctccaaatgagttttgtatttgcatgtcttctggcctcatacgcttaaccaactctttcacaatttcaagactgcctctctttactgctagatgaagagctgtgtctccccttgagttttgtatttgcatgtcttctggcctcatacgcttaaccaactctttcacaatttcaagactttcgtaatatactgctggatgaagagctgtgtctccacttgagttttgtatttgcatgtcttctggcctcatacgcttaaccaactcattcacaatttcacccctgtttttctctactgctagatgaagagctgtgtctccacttgggttttgtattcgcatgtcttctggcctcatacggttaaccaactctttcacaatttcatgactggcccaacgtactgctgcatgaagagctgtgtctcctctagtatttaacggaaagcgtaccgtatcaggacatttatcaataatcgattttgattcgaaccacctattatccaatatattaaggtacagatcatataaagaacctgcaatcgtttcaaacttcacattattacatgtcctttatataataatcataactttttgtatttagttgcaaagaagacccttttaatttctcgtttaccttaaatctgtaaaaattctcttggaaacttgtctcaaattttgaattcttaataatttcatcatttgtaatttgaaatctacctgagaaatttgagattatgtagtagtcgaagggatccaatcaccaatcacctttaattaagtttgaaaattaattctatgatgataagtaaaattatttttgagagaagtaatttatttttattttcttcagttgttgacaaaagctaattgatcttaacatgtgacttatgtatactcactttaaaagcgattctactttttttatctttcgaataaaaaaaataattttctaaacccattgttgaaatatcattcgtataataatagtataaatatatattttttaacgtcaagtggtttcaaattcaatttttttcaaaatgtaaaataaacaaactcttaagacatgatctctgaaatgcaccctcttgtgaatgcaatagtttcaagtataacttactcagtccttctggagtcatttcattcactcctctactttcatgttttggtgccggcgagtttgttgaagtggcaattggagtttgctcatgactttgattaatctgaattatgtggtcatctgaaacttcgctattggagttcatgatttaattctagggaaaatgaagtgatttggagacttctctgaaattccctgttctataagtgttgcttctttctttccagcctgcgaagcttgaacatattatatatggtggtaaaacaagagcccttaattagtttttgaacttacacttaaaaataattattcttatatgacattttgtggattacagcaatgttcaatctgttcaacacctcaaccctacagttttcaaaagctttttaagttgaaagatttctaaatttataatattaattcttttttaaagtaaataaatatattcattaaatttgttaacagaaaaaaatatatccattataaaaaaaattatattcattaaattgtgtggattagcgagactcagctatcatgacactgttaattaacttactctcaatttaatattatatttcttcgttgtacaatgatatgatagcggttgttgtatatttatgatatatttatctaactttggttgacacatttaattctatgattatttatccaacacatttttataaagtttaggaagactcaggctaggatgggaccgtgtaatttctctcaatttaatattacctgtcttcgttgtacaatgatatgatagcggtggttatatatttattatatatttatctaactgttgacgcatttatactagttatagtcaactactccaataaccattgaattcaaagcaagactagatgcattttattatcgaaaaatgtatgaattttattaaactcactacaacaaccagaaatcaatgaccgtaaatttaggaagacgcaagctataatgggagagtgtaatgggtctcttacagtcagaaagtattttatcaccatcagattatcttatttaaaaatcaatgacagtaaatttttcttcttttattattatttttcctttttttgtcctcctcttttccgtactaccatcttcctctttcttcgtctcgtctcttcttcccattcttcctctcttcgtctaagcggcaacggtggtgccatgatggccgatgatagtagggatgttgatgagtcgttgcctgaccgttgtgcacagtaaactagagagaactcgagagggtcttttgtcgtttttcttgcggcgttctgccacaagattttaacaggagaaaaagcatggaagacgaaacagtcacaaagcttgatataattattgcctcacttaaacccaaattggattcatttgaacaaacccagattttagtctcccaaagttttgagctttttgatattttttgtgtacgtgttaattttttctcatgggtgccaagttacgagtttgtttcttgcataaacattgtttctataccattattactctcaattttgagtccaatttggaagaataaaagacctaagattttggttttgaaaatcatgacattttttatgacgatttgtgattatatttgaaattgcagtttcaagaaaattattgtaccgttgatatgcaatatttgtaacttggccttgttttctatgtggctccaccactgtagtgaccatctgtggatgtggaatagggaaaaaggaggaaatggaggggttgccgaaaattgctttctgcgtaggtgtcattgtcggatacaagaaaaatggaagaaaaggaataaatcggcaatggtgatgaataagccagagggataaatcgggaagtcaagaagaaaaggaaaaaattataaagaaaaaaactcatccatgggattaaaatttaataaatctaatggtggaaattcacttttccattgtggaagacctattatattctcccacgctagtctttgtcacgattaaattgtacattatgaaagatttaatactaaaaataatattcaacgaaattatagagtctaaacgtatattttatccaaaatatttcaaatcttgctttgaattagttgttgacacttgacaccttgtttcatattaaattgtgcaagatgtaactatatatataggatttaggatttaaatcatggataataagaaccctaaatcctaaattataaaccacatggaaagaaagactttgacatggtgtatgtgtagtttacggaaaagataacatggattaattatagtgtgtttggattttggctttaaaattatcatgaaatatggtgagatgaatcaaatttaattttatctaaaactagttaaatggctcatgactccacctttagtaattttacaatttataatttttataatattataatttttatgtatttaattattatattttaattaatataatatgttaattagtatttaagctgacatttttattatcattataataaatatatatgacaatttaataaaaccatgataataaaaaaaataccataattattacaaaaacatattagtgttaattaaattataatccatattgtctcatgcatcaattatttttagactataaaaatattcctaattaaataagagagaaattatattagcatatatatttagaagagagaaaaacattaatgacaatagtatttttgaaaacatattattttagaacaattttttttactatcaacttagttaattattttttttaatcttaatggattagataattaagtcttataaataggaataaatagtataatatagtagatagtagattttgcatgtttagttattttagtctaatcaattttaattgaaaaaaatatggtgggtggaattaaagtaggaataacttctacttctatcaaaataaattctagttagattttgtctaatttactttcacatcaatactctcatgcatatgtttgtttttttttattgatttaaaaacataattaaaattcttgctatatttatagattctagttgttatatttttttattgaatgtattttatctaattaatccttgtactcataaccataatagaatgataaatcatttagaaaaaggaaatattatatttcagtttaactattggtacatttgggtttaattatatatatatatatatatatatatatatatatatattannnnnnnnnnnnnnnnnnnnnnnnnnnattgtaatagaaaattagtgtatatagacattcaaatccgttttgatcatattacatcatcaaaatcaatttaattcaaacaatacctatatatatatattatatgaaaataaataattgtaatagaaaattagtgtatatagacattcaaatccattttgatcatattacaccatcaaaatcaatttaattcaaacaacaccctcttaataaatcacttttatgatgttgatggagtatggtttgatccttccaagtgttttgttcatcttttcatcaatgatattttagagtgaacgatatagtgttaatgaatcccattagctagactttaatttgctccccgtttcttaaaacatcatttttctgatgattgtatgcacttgtgtgaatttcccatgcctttctttaatttgctgacatgaggggatcgattagagcttatcattagcaaaaaatggtttatcgtccaaggaactgtagtttagctaaataagagaaattgaatcacatgagcaagagattatctcaggatggaatgaagggaatttcaaaaactaaccatttttattaattgatttttctagtacattcaattgtgctcttgtttctttcagtaaataaaaaaaagtccaaaaattcctaattttttatctctaaaatcaaaagagtaatcgataatttgattgattgtatatttgataaatcaaatggtttttttttcatcttgtccttaaaaaataaacaaaggaacatttgtttgcatcacttagtgcatcaattggaaacatttataaatacgtaataactccaatggtaacatttattagtagtcgttaatattgaaaaaggatgccaaatttgtacagccctacaccgtatgtaccattatacagtgtagctgcatttattccatacaatacatacatataacatgcatatttaatactaccttagatttttttataagaaataaattttagtgtaaaatacactacaatttatttctcttacattaccttcgaaggaataatgcaatacatacacacacatatatagtcttgatatatatactaaaactttcaccttgccaccacatttataatcttctgtaacctgagaaaaaagacaataatttgttcctcctcagaataaaaataatgatgaaaccagtattatttttctaagtttaaagattaatttgatcaaaattaaaatatggaaactaatactaattaatatttatcgagattcgagagcacagagattaaaaatatgccttattaagagaaaaatgggggtgcagggttttcgcggtaacttgcccaggccttctcctctcgatttcgagcgcatgtccaccggtttcatctcaatcggacgtcccgatcaaaagttatagccttccgtaatttacgaaaaaaccgcgaaaaccctgcacccccatttttctgtgccacgtgtcgccaggagagcaaacacgccccatctgggcgtgtttaaacacgccccagttgggcgtgttgcatcaccccattttcctaaataattttggatttgcccccttttgctaaatattgattaaatttgtattatttataaaaattagcccaaagatatctcctctctaatttttatttctcttaaattaaatatttttctttttaattacttagttttcacctattatcttttctcaatttttaacaactgtatttctctttagaatttatttgtttctttcgtaacgaacctgatgcatcccctcctctcttattttatttctcttaaattaattttatttctcttattatatttttcttttctccaattttatcaactgtatgtctcatttcatgtttttgtttctttcgtaccaaacaatcaggatgcaaaaaaaaaaaaaatcacgttgctgattcgtgagcttacacgttttatggatgtgaaacagagatatattaaatgcatgctctttacaaataatcatgattaacataaaatagataatgtcaaaaagaggtatatatattagacattagtagcaccagagaaaataaaaatgcgtcagaaaaatcatcaaccactagattcaaaaacaaggcttatagtaatgagttgatggatcaatcatgaaacgtatttagaatagttgtggaaaaaatattgttttaataattgattatatgaaattagttttgtgattagatgtattatatggaaaatgattttgagataatttatattatttgaatttttaaaataaattttattaataaaactataaaaatataggaaactatttgtaatggtttgttctatttaaaataatcaattgttataaacaaaatgagaaagcaaaagttatctaaaaaatgaagtgttaacttataattataaaattaatttgtgttgcttacttgaaaatggtaagaaaattctctttgcaataaaaataaaaataagatgcattttaaagaacttatttgaatttatctatgtctttaagttaaactaaataattataaatcatcagaccgattaaaaaaataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatctaaaagctaaattaaatctttgtaaaaaaaaataactaaactaaatcaacttacaaatactcctaaatattttagaaaacttatatatgtccaaagttatgttttacttattccaataggttgtttataataacttataaaaaaacatataaatagactcacttaaatttatattttatttaaagagcaacttatatataaatatatctataacaaattaacaaaatcttactcagtacataaataatcaagttatttaaccaaatatagacaatgatacccgtctaacattgtaattcctaataatgaaaaatgctatgacactttttcttgtagatattttttctgtaattaagtaaaatttattgaaattttttaattttggtgggtttcacataatgtttaatgattatgtttcttaatttaattgagagacttaccaaaattgagtatattatgttgttgatatttttttcttcatattgcacatgttgtattagataaatgataaatagaaattatactgaaagtgtcaaggaattaagtcctctgtcaccgcttactccttctcaatgtcctactaaacctacacccactaaagctccatcactattagaataagtgccaaaggttcctacacaacaagggcgagaaacttcgatcatcttcacaagcaaaggtgctaaaaagaaaatctaccagaactcctagtgttttgggttcattttaataggataaatgatgatgttttttgtaagtattgtcgcaaatcatataagactaatagttctaaatatggaatcactaatttgataaagcatgtaagagactgtcaaaaatatcctaaaagacaggttgataagaaacaaaagactattgctcttggaaaggaatataagggtgaccccaatgttgtcagtatgaaacttgttgaatttaattaagagcgaactcttataacacttgcaaagataataattatagaagaacttccttttaaatttattgaaaatgaagaatttaggaagttattcaaatttttaattataaatgataattatagatgaacttccttttaatttttgcacaatttattcaaatttcaaatttgcaaaataaaattatttgtaaaatgttatgatccaattaacttaacctaacacaactcattcatgatcgagttggtttgggttgagtttgatagaaaatttctcaaacccaatcccacccataattttttgattgtattgggtgacggatttagtcaaacccactccaacccaaccatgtacacttcgaatcagtgtattgtttaacatataattcttaatataccaacatattagtttaagtttcaattgtctatataataatgcattttttaaaattagtttactagttatctaatttattttttaggtttgatttggtcctctaatttttttttgaaatttaatttggtcatttaatttttaaaattggttcaatttgatctttccatctaaattgaatcaatgatgttaagaaaccacacttttgtggcatcttaaaaatagtacttaaggacaattttaaatgtcacaaaatgcacatttaaacggtatgatcactcaaattaatttagatggcataactaaagtgaattgattttaaaaattagagaaccaaattgaacccaaaaataattagaggactaaattaaatcatttttaaacattagaagatcaaattaaacctaaaaaaatagagaatcaaatcaaaagttaaaaataagttagtgaaaataataataatttgaccttatttatttatttatttatttattgagaaattgtaacgcatttaattttaacaaataaacattgacaaacatttaggctttgtttggaagaaagattttagaggggaaggaagggaagggaaaggttcaggtggtgacatctccttgtttgggagttttaatttttgaggagaacgatttgaggatttttaaaactactctgaaatcctccaaagccaaaaattgttgttcctccaatttgggagtttttaaaaggaaaaataattaaaattattatcctaccccaactacaaattcaaaaatatataaaaatatatttttaatatatttttacatttaaagtatataattttcacatttgacatcttattaactctcaattttcctctcttactatatttttaacccccaaacaaggaggaatgaacttccctcattttctttcctttctttttcctcccttctcattgaatttctttccttccttttccctcataacttccaaacaaagtcttagacctgcctagatccaaggagggcaagtacttcaagattgtgaccccaaaatcgcattgagtacagaaggcaccagcaccaccagatcattctgctataaagttcgaatcatcaccatccacactcttgacgaaacacgcataaattaatacacaatcaattatgttaataatttcgatggcaatatttatctgtagtagttaatactgaaataggatggcaaacatgcacaaccccacacagtttgtagagtcaatagctacatttattcagttcatacatattattactcttgcgcccaagctagtcagttgcataatcttcaataacatgaaaaaacaggaaaggcacatttaataatccaaagtccaaacagacaagaaatctaggcatgtgaaggcccataatatttgaaatcaagaaatccatttttgtaatgtgaaatcgataaaatactcgttataatttttttatttagtccctttgtttcaaaaaaaaaaaaaaacatagacacatagtctttgcaaaattattttttcatagtcttcgtatcattctatgattctatcattaacttttcgtttgtttttgtacggtaagtgtcatttttcttttcttttttatttgattcctttaaatatcacaagtttttcctttctttctttcatggtaaaatataaacctagctatgtgctagaccgacacggaaagaggattaagagcaacagtgatggagttgaattccttaacctccttgaagttcaaccatgctttctctaacaccttagtttcataaacctttttcgtcacaccatcatttgcctccaaagttatatagtacaatgtgccagaaaccacttgtttctttgcactaatcaccctcacaaactccagaactgcattctgcgtttccatgcatattcaattaaatcataagaaataaaaaaattgtaaactgaaataaaaacaaaaatatataaaactcagatatgtgcttttataaatgttattgtctaatcataatttttattttaatacatcacataataaagttttgtattaaaaattggcatgagttagtaagacaaaattccaatttataattacaaaaatactgctcaaaatttataaaaatgaattaaatttcatttttttatacacatatatgtttataagtatttgactaatttctcttgagagatataaaattattcaaaggtcagatactcccttccaaagacaatataatttaatttgaaaaacctgaagtttttatttcattatttctcaacattaaaatattgttataaaacaattatttgattttttaaaatttaaacataagtaaaaaaaaaaaaaaaaacactgctaaccatctctccctccatttgatcacgtctcttagtgagaaatatgacttggttaggattcattaattataatttcatttctcattttctaacactctcaatcaagaatatttttttatcactttatttctcttcattttaattttatatttattataattttgttgtatatagtaattcttttcaaatctagtaggattatctcagtgaaagatgaatgtgtaataaaaaaaagatttctctccgttatgatttgcaccctagcttcaccagccacatggaaggaaggggaaaagctttgacgtgggttatgtggttatgccaatgtctgtaataagttagtcctgtttggacaaacgataaatctagaccacaagtgttaagtttgtccaaaaagttaaattgaaagagaagaaatagaagtactgggaaaaaactcccattgaagccactgcataagaaacccacttggaagtgtgatcactatcaaaaaggaggctgcagtgaaagccgcaaccatagcagcaacggagataataagtaacgcacgcccaaaagtcaagctgggatgtagtaatatcacaaattggctttctgaaaatcttgatggagtgaaattcggcaagattgagagtatagacggagaataagtgaataatgcgactgcatttgtcaatacgctcattggttgagatcaattaatgtcaatgcatagcttgattaatcttttaattaccacttaataactatcacaagttaaattttttttaagttgtgatattaaaaataaaaggaattgacctagcttgaaccatgcgagctctctttgcatttgaatgcttgctcttaaactggacaatgctttgaattcaagtggcagatgagcagtaagtgtagaacgtcgttaccttcattgtccactgctcctactatatgctctatctttttttaaaaaagtatactaaaaaatgcttatttttcgatatagggcagccaagtgcagcaggttccgtccattgtcggggtcccttatcatggtcactagtttactattatcgtcaagaatccaactaagagcctcaccatttcgatatatatttgattggtccaacaaatgtataacatgtgcataaagaaacgagttaaattaaagtttgggcttatatgaaacatcattttttttacacacatattcaaataactaaataaaacacaattcacaaccgatcatgaaagcttacttagaatttctgaaggctttcgcgccagcatatgcaatgctgttaacttctcttttacctcttcatctcttgcaatgtcaaatcagttggatacttttcaaataatttcattgccacatctgttacatgcacatgcaaattaaatagcgatggtggattgcatatgtacaaggcaaggtaaaactccaactaaattgaaaaaccacgtacgagttcaacttgataaaaaaaaaaaaaggatgtttggttaattggttttacacttaccaaacatgttgctgctaatggtcataaaaaatagtcgttgaatatccttatatagttatataccattttgtgaagcagattctgagaggacaaaatttgcaccattttgttgtggccatataaaacagccaaccgaactggaagcatcccatctgagtttgttatcggtgtagaacgattgtatatttgataaatcaacttttttattgatacaataattctccttattttatcaattgtacaactagtacacttttcgtattctaaccaaactacaacaacaatatattggtagaagtgactcagttgatttttaagtcactttacgtgaagtccacattgctcacagtaggattagtgttagaaaacattacaattcaataaatttgattgatgggaataaagttagtagaaccgtagaaattaaaagacagattgattgatgttaattaatgtaaatgtattttctcttgatattcaataaatttgcatgtcgtcatcgttacaaaaaagataaactactttttagtttctaatttttttaaattatctttttagtcttttgaattttgaatttatatttataattccctaattttttttctcatccttatttttagttctttaaatttttttcatccttattttagatccttttaaggaattaaaagtaattatgtaataaagttaaaaaaactaaaagtcagaaaaaaaacattaaaaaattaaaaacatattaaaaaaggtgttaacttacaatcataatatattttcaaaatttaatttgtttatacgaaaagaaaagaaaaaaatataactttggaataactaatttctggaactactaactacgtatactagtaccgctgctaattgctattaaaagaagtaaataagaattaaagaaatcttataatcttatttgaaatattgaatatttggtgaggagatgttcacataaagatatataaaaggtgttgaaccacattaagctagtatctttaaaatttctaattgtgatattgtttgtgtatatgtttttatcatgtgaactcacgaaaagaaacatcctcagaaaagatagggtgtcatccgatacggatatggataaaactatttgcgatttaaggttgtaacatagaaattttatagccgaatttctattgacacagttacaacatatgagtagcgatatgtcttattaaattggatgatgcattcctgtgtttatcactttattcgatctaaattcctctgtggatattaattaaaatataggtccttgactgtttgggcaagtcctcgcgagggaaccttatttgttgaagcatgtattacatttttttttgcttggaactataataacatatccgtagagagagtctcacaattgatttttaaagcagcatggcttcacgacaggttcattccattgctcaaagttggattagtgctacagttatgagggaaagccttaggcttctactcatgaactgaacgaaaagaaaaaataaaattgctcacgagctctagctaatttatgctagaaacatagatgacacaatttgtttgatagagtcacaccctcaaatacactctttttatcccactctctttcattgttccatctcatcttattttttaacctcgtccttattgatcctcactcaacctctttgcaaagaggtttgccaatgaataaaataaaggggcaagttacttgataggcatagggattgacgatttttggttcttcaaaatatgaataataaaacaaaataaaaacttacaaagtgtcataacctgaataataaccggtaaacaagtagctattttaaaaaataaaatgagatatatgaaccgatgaaagatactggtgaagaaaagagtgtgtttgagaatgtgactctaatattcttccttattttattgtagatgtattttcacttttttttcatcttgtccttaaaaactaaacaaaggaacatttttttgcatcacttagtgcatcaattggaaacatttagctatttacgcgtaaatacagaataatcaattcgtaatattattagtagtcgttcatattgaaataggatgccaaatttgtactgtcctacaccgtctgtaccattatatatagtagctgcatttattccatacaataaatacatataactgttgggtcggtaaccctatctatttgcggaagcggaatgaacctgtgaggagatggaaaattatagaagcagaaaaatatcacccagagaacacacaacgattttaacgtggaaaacctcctcaatgtgaagagtaaaaccatggggcactgacccagaaaatcttccactataaaaataggattacaaaagaatgatctttctagtacaagactagagacttacacataaaatttcttcacccactaaggatggctcataatatttttatctctcactggaaggatttctactctcactaaaattagtggatcactcttttctctgaggaactttttctctcaggtttttctctgatttctgatctgctgaactgaagaaatgaatcccctatttataggaaattcttacgcgtaccgatccgtaaattcagccgcaccgaacgcatttctcttcctttcttcctttgctttttaatttttctttgcgtgggccccacacgctttgaaaaattttcctccgtctgttaaggaggaaaacggtgccaacaaatctcccccttttcgacttaatcagacggggttatcaaaccagcacctttgcaacaatcttcgaacttccatgttggaactatcttggtcataatgtctgaccaattcaggtcagtgtgtactttggcaagtttgagctgtccatcatccaccacatcccgaatccagtgatatctcacatcaatgtgctttgttcgggagtgataggtcgagttcttcgttagatgaatggtgctttggttgtcacacatcagcttaaatttgtcttgttcatggccgagttctatgaggaacttcttcatccacagcatttccttgcttgcctcagtagcggcaatgtactcggcctcagttgttgaaagtgcaacacacttctgaagtcttgattgccaggagattgcccctcctgcaaatgtcatcaaataaccagttgttgacttccttgagtcggtatctccccctaaatcagcatccgagtagccttgcaactcggcttttccttctccaaattggaggcatagattggttgtaccacggaggtacctgaagatccactttactgcttcccagtgctctttgtcggggtttgataaataccggcttaccattccaactgcatacgccaggtcgggtctagtgcaaaccattgcatacatcaagcttccgacggcagattggtaaggaatcttcagcatctcgtctttgtcttcatcagatctcggccattgcttcttattcagcttcatgtgcccggctatgggggtgcttactgttttggctttatccatgcagaatctcttcaaaatcttctcaatatatttttcttgactcagccacagtagcttcttctgtctgtctcggatgatattgattccgagaatctgtcttgcagggccgaggtccttcattgcaaaggacgagttcaacgcctttttcaaagcggttatccgttctttgtattgccctacaatcagcatgtcgtcaacatataacaacaaaattagaaagtctccattctcatacctcttcacaaatacgcagtggtcagcttctgtcttcacgaacttgtgatcagtcatgaaggattcaaatttcttgtaccattgtcgaggtgcttgctttaagccacagagactcttcttcagccggcataccatgccttctcttcctagagctcgaaacccttcaggttgttccatataaatttcttcttttaagtcaccatgaagaaatgccgtcttcacatccatttgttctacctcgaggtccattgaagtcgccatagctaacacggttcggaccgaggtcattttcacaacaggagaaaaaatctcctcaaagtcaacccctttcttctgattgcagcctttcactacaatccgggctttgtatctcgacttctgcccgttctcctcctgtttgatcttgtacacccacttgttcttcagagctcgtcttcctttgggtagctcggtcagctcataggtctcattctcatacagggatttcatctcttcctgcattgctttctcccattcttctttctctgagctcgtcatagcctcatcataactctgaggctcaccgtcttcagcaataacggtgtattcatcaggtgggtaccttgtagaagatcttctttctctaatgggatatctcgtctgtccatcagcattatcaacatgagaacctggttcatcattatcatcctggatttcatcaccttcttggacctcagtgtcttggtcctcattagcctgttgttggtcaacattttcttcattagtttcttcaatggtttctccccctgtttcagttcgaacaggtggaacagattcctcacgtcgaacagaaactcgaactttgggtttcgagatgtcatgaatggtctcattttcatgaaagatcacatctcgacttctcactatcttcttgttgattggatcccaaagtcgaaatccgaactcggattttggcgaaccgaggtaaatgcattctttcatcttcgcatcgagctttgccctttcatctttagggatatgcacgaaggctcggcatccaaacactttcaattgatcataggccgctttccgacctgtccagacttcttctggaatttctccttcaagtggccgtgatggtgagaggttgatcaagtcaacagcagttctgacagcttctccccagaatgatttcggcaatccggcattggatagcatacatcggaccttctcttcaatagtcctgttcattctttcggcaattccattcagttgaggagtcttggggggcgtcttctcaagtcggatcccagcttctctataataggcttcgaagggaccacaatattcaccaccattgtctgatctgaccacctttaatttcttgccagtctccctttccaccatagcatggaattctttaaaggcttggaggacttggtctttaaatttcaacaaatacacccacactttgcgggagtgatcatcaataaaagaaacaaaatattgagctccaccaagtgatctttcagtcatggagcatacatctgtatggacgaggtcaagaatatacctgcgtcgtctgggttgatccggtctcacaaacgaaacgcggtgctgctttccagctaggcagtgcgtacagctttccaacgcttggcctttcaatccggtcaataatcctttcttgttcagaatttggagccctttctccctcatgtgacccaggcgcttgtgccatagttccaagctgtgtccatcttgaaccgaattggtttctccaccatttatctttccttgcatcacatacaaggagccttccctttttcctcgagtcacaaccaagtttcccttggccaatttccatctactttctccaaagtagtttactaatccggcatcatcaagtttgcctaccgagattagattcaggcacatgtcttacatcttttaacacaagtcgacacccgacatccgtggtcagggtcacatcaccaataccaacaatcttgctggtcacctgatttcccattttcacgactccaaaatctccttttctataagcagagaagaatccttcatgtggggtgacgtggaaggaagcaccagaatcaacaatccaagtacagtcatcatatgcaacattcaaataattatcctcaccgattaaaaagatatcggcctcggatttggctgctacggcagtggtgctctgctcttccttcttctttggatctatctggtctggcttcacggtgccattcttctggtcctttttgagcgtccgacattcgaacctcctgtgacctggcttcccacaatagtagcatgtcagatcggatctcggttttgaccgtcctcgagacttatctcgacttcggcttttactccgtcctcgattttcagatctcccacggttctcgacgacattagcctcgtattggctagtcatcccacgttcttttcttctagcctcttcattcaacaggctgtctgctactatgtccatggataattttccttcagggaccgagttgttgagcgtcactactaaagtgtcccagctctcaggcaatgagctgagtagcaaaagcgcttgcaactcgtcatcaatcttcatgtcagcttttgttaactggttcacgagccctttgtatgtgctcaagtgctcgatcatgctttgttcgtccctgtaattcaacttcacaagtctacgcaccaaacttgctttgttgcgcggtgtctttttctgaatcaaagattccagcttcatccagagctcgtgggcttttgtgtaagtcgacacgtgctcgaataagctcttgtcaatgtacttgcggatcgtaccgaccgccttccggttgaggacttcccactctttatcacttttcccttctggcttgtttgtagacagaatgggttcatatagatctttgcaataaagatgatcctccatcatgggtttccagtatgagtagttttctgcggtgagtttgaacatatcaccatcatgtgctatggcaccctccatctctgaacagtaccgtatgtgtgaacagtatcgtacgtatgaatagtaccgtacgtatgaatagtaccgtacgtatgaacagtacagccacccaaatagtgatgaacagtacttttcactatttaaacctccaacctggctctgataccactgttgggtcggtaaccctatctatttgcggaagcggaatgaacctgtgaggagatgggaaattatagaagcagaaaaatatcacccagagaacacacaacgattttaacgtggaaaacctcctcaatgtgaagagtaaaaccacggggcactgacccagaaaatcttccactataaaagtaggattacaaaagaatgatctttctagtacaagactagaggtttacacacaaaatttcttcacccactaaggatggctcacaatatttttatctctcactgggaggatttctactctcactaaaattagtggatcactcttttctctgaggaactttttctctcaggtttttctctgatttctgatctgctgaactgaagaaatgaatcccctatttataggaaattcttacgcgtaccgatccgtaaattcagccgcaccgaacgcgtttctcttcctttcttcctttgctttttaatttttctttgcgtgggccccacacactttgaaaaattttcctccgtctgttaaggaggaaaacggtgccaacaataacatatttaatactaccttcgagtttttttattctcttacattacccttcgaaggaataatgcaatacatacatatacatactttaactttcaccttgtgaccagttataatcttctgtaaccagcaaaaaaaaaaaaagtgaaagacaagacatattaaacaatcccaacagacaacaacactgtggatatgaatgcccagaatatttggtcatggtagtttagtaaattaaaggataaaatatcttttcggtccatatattttttttaataaaacttgattttagttctcaaattttagttttaattaatttaattctcgaattttaaaaaaagacaataatttattcctcctcagaataaaaataatgatgaaaccagtattatttttctaaggtttaaagattaatttgatcaaaatagaaatatggaaactaatacaaataaatatttatcgagaggacagagattaaaagtatgccttattaaggctaggccgacaccgaaagaggattaacactgagagtcctcgaccccgtgccacattttttttaaatatataccaaaaggcaacgggggtcaaaatatttgccagaatgccacgcggcctatttcgctgggcagtccagcgaaataggtgtgctgacgtggcgccaaatgactggaagacctatttcgctggagagagaagcgaaataggtatgacacgtggcaggcgttgaaaattgcgtataaagtttggaagaccataacttttgactgggatgtccgattgacgaaattggtggcgaaacgctcgaaattgagaggagaagccgctgacaacttgccatcttctgtacatcactactattctaaggctttttatagggaaaatatcaaagtttatcttatatcattctgattgaatttgagtggtaaacaaaaaaagatcaagagaatgaaagatgaaatatttttattttgtcttatgcaaatactgtttttgaggtaattatatgtcatgcattaaacgtggattcttattctaataagaatttgaactattattcgatccaatgttgtaaaagaatagtccattccattttacctaattctaatatatatgaaaaatgttagtaatacattttaaatacgatttttttcctattgattgaaattcttttaaatttcaaaaatttgtaaatcttacatcttatttaatgaatttatttatgattttggagcatttaataaattctaataataataataataataataataattaataattattattttgacatgaatatgttaaaaactgttatgctagccttgatctccgctactgagtgtatatttaattactatttataacaattattcatgtacgttttttgtgttttttattttaacaaaaagcatttttttaactattgcatttgcatatgtgtgaccaatctcatatattccctttgtcaagacatctaatttaatttattgataacatacctgaattgttataaatttattaacattttttcgattcctactaaaaaaatctcatattctccgtacgtcgttttctcgtgggtgtttcaatgaattattgtagaataagcgggaatatgagattttaagttttgttttcaaaacttacccccttttttttgctttttttggtgaagtcataagtgacctcacgactttggctttttttttttttttttttttttttttttttttnnnnnnnnnnnnnnnnnnnnnnnnnnnnnnnnnnnnnnnnnnnnnnnnnnnnnnnnnnnnnnnnnnnnnnnnnnnntttgtttaatttttttaaatattttgtttatcaaatgtttataaaataattttatttattatttaagaatttagtaattaatattatttaatatttttgtttatttattattttttatatttttttatgttttaaatattcctttttttttaaattaagtttttaatgttttttaacattaatttaattaaataattttaacaaacttaagaattaaattaaataatttaaaaaaacttaagaattaaaaacaaaacttaaattaaatatttaaaattattgaaaacattaattattttaaatattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttaaaagcaacttatatataaatatatctataacaagttaacaaaaacttactcagtaaataattaataaatttatttaaccaaatatagactctgatacctgtctaacattgtgattcttataataaaaatgctaatgacacttttttctaacattttcttttagatatattttctgtaattgattaaaatctattgaaaatcattaattttattagatttaatatgtcatttaatgattctctcttgatttaaatgagagacctgttaaaatttgtnnnnnnnnnntttaatatttttgtttatttattattttttatatttttttatgttttaaatattcctttttttttaaattaagtttttaatgttttttaacattaatttaattaaataattttaacaaacttaagaattaaattaaataatttaaaaaaacttaagaattaaaaacaaaacttaaattaaatatttaaaattattgaaaacattaattattttaaatattattaaatttttaattatttattttaagttttgttttcaataattaatgttttcaataattttaaatatctaatttaagttttgtttttgtttttgtttttaattcttaagttttgtaaaattatttaatttaatttttaagttttttaaaaattaaaaattatattaatctatttaataaattaatataaataaaaataaaattaatctatttaattcttaagttttttaaaattatttaattaaattaatgtaaaaaaacaataaaaaaacttaattaaaaaaaaaaggaaaacggttggaagtcgtaacagcaattaaatattaaaaattaaaaaacagtaaaatttttaaaaaaaaaaacaaaaacttgagaagtcgtaaatatatttacgacttccaagtcgttacgatttcaaagtcgtaaatatagtttcgacttctgtggaaaaaattttacgttaaaattactaaaaaaattatactgaagtcttaaaaaattttacaacttcaaattaaaaaaaataaaattctggttgagaagtagtaacagatgttacgacttaccccttttcagtaattaatttgaaaactacccccaaacggtaattaaaataaaatgcccctgatgcgtaacaaagccccctaaaattttattatatatatatatatatatatattaaaaattaaaaaaataatttaataataataaaaattacattgcataatataataagatataatatttgttaatatttactttaaaaaataggataaaatatttttgagattgtattacataatataatagaaatctttaagattacattgcataataagataaaatattttttaagattgcattcaaatataatatagaatattttttaatattatattcaaaaataggatagaatatttttaagattgtattgcataatataaaatatttttaagattgtattgcataatatgataaaatatttttaggattgcattcaaaaattggttaaaatcgtatgcttaaattagtataaatagaaacatatttttgtgttgatagtatgcattccattccaaataatattacagctttagatagtttatgtttgcatcattgagagaattattatgagatcatataaaagcgtttgacaagtctgattcttaactctccatcagaatttaaaggtacttatttattatcatagtggagttgtccattggattgattatccaacttggacgttgtgattttttatccaattggatttttcacgctaaaactgatgatgtcttctttatctcttatctccatattattactttgagtttaattttaaattatgaattattttattaagactcacaacccaccctgtttgcaatttgtatgtatgtgatttacgatgcatctttttgtatattagatttgtattgtcttcagaatacttttatttatgatataattttttttatgttcgttccccaaaaaagtttctggttccgtcactcgagacaactaattaacttcaaccttgatattttttgatacttgtggacacaactcacccatgatttaagcacgtgtttggatataaagtgtgaactacgattattatgtctccattatgagttggttgtgaaactgtgaaagctggtacactatgtttggcagagatataatagatagaagaaacaagaaaatgaggatgatatggaataaaaaatgatggagtatatttgataaaagagaaataggtgaagagagaattaaaaagatatatatgaaattaacgatgactagaaatgaatagtaacttctccccctctctaatttgtatttatcttaaataaaatttatattattttacttagttttcacctatttttcttttcccaattttatcaactgtatttctctttaaaatttatttgtttctttcgtaaagatccggatgtatcctatttttatttctcttaaattaaatgtttttatttttacttagttttcacctatttttatttattatatttttcttctctccatttttatcaactgtatttctcatttcatctatttgtttctttcgtaccaaacaatccgaatgcaaaaaaaacaatcacgttgctgattcgtgacgaccatacacgttattatatatggatgtgaaaaagagatatattagatgcatgctctttacaaataatcatcaacataaaatagataatgtcaaaaagaagtatattagacattagtagcaccagaaaaaataaaaatgtgtcagactaatcatcaaccactagattcataaacagggcttatagtattgagttgatggatctatcataaaatgtatttagaatagttgtggaaaaatattgttttaataattgattatatgatattagttttgtaattagatgtattatatggaaaatgattttgagataatttattttatttgaattttttaaaataaattttaataataaaactataaaaatatatatatatatggaactatttgtcatggtttgcttatatttaaaataatcaattgttaaaaatagaatgagaaagaaaaagtgatatctagctaaaaaatgaagtgttaacttataattataattttttttgtttacttgaaaagggtaagaaaattctctttgcaataagaatataaataagatacatttgaaagaacttatttgggtttatctatgtctaactaaataattctaaatcatcagaccgattaaaaataataataaactgcaatttttttttttagatattttctgttggtctttggtttggtttttacatcgaattgttgaaattgaacctaactgcacagttaatatgcttatattcataatataggagtattttaaacttttgttcataatattttttttataggcacttttgttcataatagtatgtgtagtgaatacaaaacgaactacatattctttcgccttttgatcataatagtatgtgattttaagaatggtagatgtttcataaaaaaatggtagatggtttgcgtgtgttaaataaaaaggttatgactaatcaactatgaatggtttataatatatatttttttgaaacgtgtgtaatgcatttattattacgtataattttttattgtttatgataatgtaaatgtcatttttaagagttgataatgacctaagatataacttatatatctgccaatcaattttacaatatatttcacttaatgtcaataaatattaagatagaatctaacacatcattttcatctaaaagctaaattaaatctttgtaaaaaaaaactaaactaaatcaaattacaaatactcctaatttttttagaaaatgtccgaagttattatgttttacttattttaatcagttgtttataataacttataaaaaacatatatatagactaacttaaatttatatttgattttaaaagcaacttatatataaatatatctataacaagttaacaaaaacttactcagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacccgaagaaagagaatattaaagagagtgtagctagaactcctcataatataatttttaatgcttctatgaaataaaaaaagaatatatgattttacataaccttttattgaaatgaattttactcactgattattattcataccacacaagctttgaagaagtttttcactttttgccttttatgagtatcctataaagatttttggatacttattcacttcaaacatctaattaacatgcattaccttttccttattctattgtataattatatcaatccttatatatgatagattagacattcaaacaagacttaaaatgtaaataggtacagtgataatatttagatatccttatgttgtagtcattcacacttcctatttttctctagttttctcttcctatcatgtcaatctaacgtagttatatttttgtctcttttctatcttttttatttttcaaaaaaaatgtaaaaaattacaatataaaaaataaagtaaaataatcacatatttattatgttattattattattattattatttatatttatattttaattatatttaaatattttatatttaaacataattaaatattttaaatttttgatttttgtcaattcttaattttatatttatcacattgatatatataatgaaattaccaaccgaaatagcttatcgctcgcaaattaatagtatttttagctaatagtatttttagcggatggtaaagtcagtcgcaaaatagcacaggtgacatcgtttttatagtatttttacaacgttagagaccgaaatgtcaatcgccaattatgaaaaaccagcgactgattatttcggttgcaaaatattataatcagattccttcgctgccgaaatagacttcgataggtttgcagccaacatacagtcgctaaatctcaatatttctttaaagcttgaaaatagaagcagtcgctatttgtgacctatgggttgtagttaaaaacattttgttgctaaattgagatttttttcccctggtaggtcaagcttaggcttatgaaatcttagccaagctttaaaggtttaggaagtttactcaaatttatagtcatagatgataattgtagaccaatttctttttaatttttttacaattcattcaaatttaaattttgcaaaataaaatcattttaaaatattatgacccaattaacctaatctaattcaatccattcaagatcgagtttgtttcatataaaatttctcaaacacaatctaatctaacccaaattttttgattgggttgggtgacggatttagtcaaacctaacccaacctaactcgtgtacacgtctaataagtatactgttcaacgcataattcttaatataccaatatattagtttaagtttcaattgtctatataataatgcaatttgaaaattaatttattcgttgtctaatttatattttaggtttgatttgattctctaatttttttgaaatacaatttgctcttgccttctaaattgagccaatgatgttaagaaatcacacttttgtggcgtcttaaaaacacttaagaatgattttaaatgtcacaaaacacacatttaaacggtatgctcattcaaaataatttagacaatataaccaaattaaattgattttaaaaattagataaccaaattgaacccaaaaataattagaggattaaattaaactaattttaaaaattggaagatcaaattaaattcaaaaaattagagaaccaaataaaaagttaaaaataaagtagtgaaaaaaataattgaacctttttatttatttattgacaaatgataaacgcatttaattttaacaaataaaaattgataaatatttaggaccctgcccaaatccaaggagggcaagtacttcatgattgtgacctcataatcgcattgagtacagaagacaccccaccaccagatcattctgctataaagttcgaatcatcaccatccacactttggacgaaacacgcataaattaatacataatcaattattttattaatttcgatggaaatatttatctgtagtagtttatactttatactgaaataggatggcaaacatgcacaaccccacaccgtttgtagagttaatagctacatttattcagttcatacatattatcactcttgcgcccaagctagagttacataatcttccttaacctgaaaaaaacaccaaaggcgcatttaataatccaaacagacaagaaatctaggcatgtgaagaccataatatttgaaatcaagaaatccatttttgtaatgtgaaatcgatcaaatactcattataattttttttatttagtcccttagttttaaaaaaaaaaaaacatagacacagtctttgcaaaattattttttcatagtctttctaccattctatgattctatcattaacttttcgtttgttttgtacggcaagtgtcatttttcttttattttttatttgattcctttaaatatcacaagttttttctttctttctttcatggtaaaatatatacctagctatgtgctagaccgtcacggaacgaggattagcagcaacagtgatgggcttgaattcctgaacctccttgaagttcaaccatggtttctctaacaccttagtttcataaacctttttcgtcccaccatcatttgcctccaaagtgatatagtacaaggtgccagaaaccacttgtttctttgcactaatcaccctcacaaactccagaactgcattctgcgtttccatgcatattcaattaaatcataagaaattaaaaacaaaatagaaaactgaaataaaaacaaaaatatataaaactcagatatgtgcttttataaatgttattgtctaatcagaatttttattttaatacatcacataataaagttttgtattaaaaaatggcatgagtttgtaagttaaaatttcaatttataattaaaaaatactgctcaaaatatataaaaatgaattaaatttcattttttatacacatatggttataagtatttgactagtttctcttgagagatataaaataattcaaaggtcagatactcccttccaaagacaatttatttttccatttaagatttaaatctctaattatttagttataatggaccaagtttaattcttacttatttgtgagacccctaatcataatcagaacaggattcaggaagtcaagtatcagagctacagaaagaaactaaacccactttggattctcaaatcacgtgatcatggaataatccagtacaccaaattaacataaatcataatatcttaattaagttgtaactaaaagttgacttaaatgaagaaaagaaaaaataaaaataaaaagaacctcttttttgttgtgttcatcaacagcaaagcgagcgagattttcgatatcgatgctgttctgtgctccagggatgtcggtaaagccacccagtgctgccatttatttctgtttttcttttgatctttctgtcttatgtttatctcttcccttctatgacttttttatatcgttgtggaagagtggtttttgattagttaaatgtggctgtgaaaatagagcctatgcgtgtcggatgttcatttgttttttattattgcaaacgtgtcacgtgtgaccaattcaattatctccttatgtttttgtgcatgatcgacgacttcaaagttcaaccttaattaatagttattaattaaattcttttcatatttatattggaaaaaaaaataagaacagagattcacactcagaagccagccttttcctccaaatgagtatgtacgacagaaaatgtagtagtagtagtgcatatatatatatatatatatatgtatgtaagtaggaaacaagcaattatacatgaacaactttaaccctgtaacttgttaggcaacaattacttgttttcaagcaatttcctctaaaagtactctcaagtctcaaccaacaaattagtcaaccagaaacggtgacatcagtgcttgaagttcctagtggcttgtgaatgaaagtacctagcttgctgtatggtttgatgaaaattgcatttgaacgaactataagtaatcagcaatggcacatactttggaatttctagctgaaaacctggaaactgcttgaagacgattctgatatgtatcgaagcaaattgagaaacacactaaaattaagcaatgaaagcctaaaaaacgtgtcagaacctgaagaagttcagacaatgttccaggtagaaaaccggcatggatcaatatattctcattagtttaggttatatgaattgtcaaaaactcaaatgaattgattttaagatgatgttggatatcaactctcttacttcaacctcagtcgatgatccacgagacaaagacacatgtcacttatgaagctaaaaagaagtgaaaccaaaacttggtaaggtaaaaaaaaaaaaaaatgatggttcaagagcaaggctcatcaggctatatggactggaagagcagcagcctgtaatccctccactgtcaagagccaggggtgatcgctgctctgtgaaaccagcctcacgcggtgcccccttgtctaggaaccaggagacctgtgccttcgctcaagtcccatagctcaactctcaacttggagcgggcaggccagcataatgcagccaccaacccaacctggctaagccagagccttgtcccaccaccttgacgcccccacttgggtcacaagctgacgctacgcagctcggcatgctgaagtgcttgtcagaagatttataaaggcttggttgcctaatattctaaccaatgtgggacttataaaggccaacaatggttagtctaatttggaatgtgggacttgattggattctctctaggctctagcaattttatccgtgttgtgttataacactaaccccaaaatattgctgtagaatgcaatggtttccacttacgtgtaaataatctttctctattaattgtgtgaccactagaaagtgaagagaaaaacatagaggtgcatcctacaaattcgaattgaattaactgattatgataatagttgagttggattgatcggtgggttcaggtattcctaagatcccaattaacttaaaagtaactactaattgatagtcattcattattttaaataaacgcagcaaaaattttcgttgcttttataatgaacatgaacaagttattactaattgatgattatttaataaattacaattccttattcgagtcactatcaaacataaaaattcaaactaacaactatgtaaaaattaacgtgagtaggcataggatgatgggagtttattcacccttgaagactgaatcagtgattcgggcactgcataacatgaaaaggagcaaagaaattgcaatacaccatgtatactatttaaggtgaggtgaatgacacagctctttagatgcttacaagttctagtctctaagtatgctttagatgttgccttaatacttttgacgaccaaactagtttcattttcctacaatgatgctatgatttaagtcatgttgctttatggaaatataaggctgaggacatctttattctatatgatagtgaatttgtgagaaatcgtctttagtatttaagagttcctttagtagagtgaaaagaataaaatgaaagtaaattaagatgaaaattttgaattaaaacatataagtgtgtatcccatctcattgtttatttctttttcttttcactttctttctcatctcattgtttatttattttccttttcactgtctttttcttttcttttcaaacgaacgaatcttaagagagagaaaaaacaatgggggtggagggatgagagggagggcaaaggagttggagtgggattaagggaagagggtggttatgtgacaccaaacaatccatgtaaatgccataagtcttgaattagataattaggttttaatttgaaaagagtttaattcttcattatatgtagtataagaaaactttataattaaatatataatttagtcttatacgaattgtggaatttcaatgtgatttttatacataaaaatggattaaattcaaatatatttttaatttcttaaatttaataatacatttgacggagatgagcaaactaataatacttgcaatataaagattgatttattaaacgaaatttatatagagactaaattgagattacggcacataagaactaaattatgtatttgacctaaattctgtatttgatggtgtatattctaacaattattctaaaaaattacaaaaaaaaaaaaaatcaaagannnnnnnacatattttaattttttattaatttttaaatactaaatattataaattcaaataataataaccaacattttttttctttgcaaagaaaaaactgaaaattaatcttaaatatgtttatggttattatgctaatggtcacatagtcatgaaaaataataaaagaactaaaataaaacaattaaaaaataaaaataaaaaaacctagaaagaactcgatcaatcggcattcaaaaagtctctctgactcttggcagcgcgaagcttggagcagcgtttctcatggcggttccaccatcggaaaccgaatccgtagagaacagaacactcctttcacagttttactctcactatctcgaaaaccgaatccaggctttctatccctacttctccaacttcgctctccgcttcagatcaacgcagcgtcgggaatgtctccctcttccactaccttcctcttcactcgactctcccgtgtaagttcattctcctttttcacttcctcaaattcaacgataaataaaataaacaaatgttcgtgtttgaatatcatttgtgattttatgattctaagctctgtttcttttgctacattgaacgaacgcatggatgaatattagggtttttgtgctgtgttcccttgtaggctcatgatcaagagatctagagtgcattatgttgtggaggatatattagagcgtgttttgataaatttgcacggcgtccaaaagaatctgcacttttggcagtccagagctaaggttctgtttttgcttttgttatctgtatatatgactttgtttggataaacttctctataagcactgaaaagaaagaaaataagaagaaaaatggaaatgagcttatgcgttagttaaaaataagcttcttggagaagctaatatatgagaaaagttttataaattagcttatgcagaagctaatttttgctcatggagaaacttgtttcgtttttacttcttattttcttctcttataagtatttatggaaaaaattatccaaacaggtagttcacactgtgtctgttcgggaaatagtcatactgcttatttgtttatcattcagaggtcggattccgagaaggcacgtttcatgatatttgagaggggtccaaaggcttttcttgatgaaacagttaagttgttttgtggactcattgctcagggttcgtccacacagaatctgagccaatctgcatctgattatattggcgagagagtaggctttttgagtagcttaagatattcactcgccacatttttggctcaggtatgctgtgttcaagttggctttttccttgtgtttgaatcacgactagtctttcataattagaatgaatataatttgcttgtctgttgttgtcaagcttactcaatagttaataatcctttgaattgtatgattccgtcacattgatgttattaatcttcatatttgtagaagagaaaaaatttggaatgaccaaatgattatgaaggtggtgttgtatcttgcatgttttcttagcagctgctgcttttcacccagttgacctagtttttctcttgtgtactttcccatttttttttcttgctgtggcacctttattgatgtctttaggggaattccttgtatgggccttcagagggattatgaggataggtttgacaggatagttcagtcagcatagaatttaagctaagttatttacatgtagatgtggggttcaagttcttctggcatatcatatgattctgtaagtgtagacaaatattcatggtgaacagatgtaatgtacacttatgaactcacctgtagacatagaaaattataaatatgcaagactttctattcaacttaactttcttaagtgccaatatgacatcaattttctgatattatttcaaatttgaaacttcatactcaggtttatatggaagttgataaaattggagaggagttagtgaaagatccagagactaagctgcccttgttgttggttacaattaatgttttgttttcaacattagaagcttcaattggacatctacatgcaatgcgtcaggtttatataaataaagttgtttgtttttgcctctgttttcccttatgtatactcttaccccttatctctatgtaccatggtttgtaaagcaaaactgaagcatgtttgcagcttaatattgtttctagaattgaccttttctatttattcagagtgattcttctgttgatgggagctattcaacccctctgctgtttgagaagttgccagaaataaatcaggcggggtctcagtggacagactgtgaaataagagatgctatcaattcagtttatcaaaatttagacaagttggattcatacatatcttttcttgtaagagcttctatattatgttatttgattaagttttggagactgtcactgtctaaatttttacctatatcatatggtctaatattcatgatatagcttctatattatgttattttcactgtcactgtctctatctcctgccaatctctgggactttgtcaatgcctattagaagtggacaaaattatcttgactggagtcaataacttgggcttctattttttgaccatatatattggatttagtcatttgtggatggaggttctgaaattgaacaattaatcaacttgttttaataatacatatttgtttctagtcgtccagcactccagcttatgttgattggtttgttaagtaatatcattaaaattttaaatttcaattttatggttgtaatatgtttcaggtcatcaaacataaaaagccaaggaaaataactcaatattggatccgctatacatgtggtgcagttggtttgtcagtatgctccatttggctcttgcggcatagtagattggtggggagttctgatcttgataattgggttgaggaagctaggaactcaacatatagcttttttaagaatcatgtagaggaaccggtacatttcttcttgataatttactatggtttcactcttttttctttttttttttttcccctccttaatataggagaaattaacttaacatatccttatgagataggtgtgatcagcattattcaattttcttaacctcatttcccttaaatctcgatctataataattagaattaactatgtacccttcgtaaaagtctgttctccatgagcaatgaagaaatttcattttcttctatcttctccctcttcattcccatttttaaatctgttgaaagtgaaccaaactgattaaggtttacaaattgatgtaggatggaagcatgaaataaggtttaatattgtctagaagctgatctaaagtgcactatgcctctatgtaatatgtatataaggttggattcccccagaaaaaaaaggaaagttcttagaatgtattataaagctaggaagagtgttgtttgttgttttaaaattaagcctagcccttaaattattctattctattcaatatcccactagtactcgtttgactgggttaaatccatcagttgaaaccaaataaaaccctttaaagtaatcgctataaaaattacataaaaatcttatgtactattgagatatgagtcctcttgcttgtcactttgtcctgcgtcataattgtacttttgtatgtattctgatgcaatcatttttcagattttgtccattagggatgaactttttgatacattcaagaagagacatcaaggtattatggacgttgaagaggtgcagttaacttccaactcactacacaggttattggtttttaaatacgttgtccgcctttttttatttttgaatactaaacctgtatgaaccttaatgctcagaatgtttaattttttttatcattacaaaatgtttaatttaacataactatttacagttttgcaatatatgctgttaattaggcaccttaataattgcttgtgaaacttttgggacttgaaaattttagtgagttgtgttgactctcttccatggcttgaattgaagctgattctgtatgtagaagatctaatttgaaaagaaatacgaaaaaaaatcaactaatagaagctgtgcggtaaatgcaggatgttaatttttctaatcctgttgattcagtgtagtctggttacctactattatcttttacaatgttttctagcatatgctaataccataagtagaagtacaatccagtaccacctaaatctgtctgaagaatttggatttattagcaacaagataaaatatgcttagcagttagcagtaaggatatattagagatatctagtcttcatactatgaattatttcattttttttatgactacctgtaattgcatttactcatattcatggatattgctttaagcttgattgacaatactcatctacttgaaattgaaaggcatgcttgttgcatggataattggatattgctttcattgtaactttttctaaaaatttctgtacagaatgttgttggctttcagtgagcagacaaagggtcagaagttcccagtgaaagcttcagatcaggaaatgatggagatagtcatggataggtgagtttggatatttcactttagaaccatctctagttatacttgtcttatggtagtaaggtacttatggaattgaatttgaaatagatacatggatttgcttgtgagccattttccttcatattatacctgtagggttcattatatgttggtaatagcttggttgttttctggatttagtactaaaatagttctcaatgccaatgacttctggggaatgaagacactgctctatagaatttctagctattcttctcgctttgatgtttcatcatgaagatgtgttatttttaatagaaagccattggtttgatattgacattaaatgagtgtactgctgtatcttttgactaaggggtttctggcctatgttgtgggttaactattctagtttaactagcggtatcttttggggttggaaatatgtgagcatttatagtcaaataattttaagataatgggttgttcattttttaagttgccttctgatattggatgtccatgttagaacaatctaaattccttacctggatattcataaaaaatattttcaatttacattgattgacaatattcaaaactttgcagaattaaaaattggattttgatggaacaaaaggacaataacatacagaaagtgttttttatatatattagtcctctctatattatctgatagggacttgggtattatggggtgcctatgtcccacattgagtagtatggatgcttggtggagtactttaagtgacttggcctccaccccccactgtaagagggttctccaagtgcttgggtgcttatcaattggtattaaagctggctgtcaactcgagaagggctatctacgaggacttcggctctcgagggcagtgctaagataaggacttgggtattatgtggtgcctaagtctcacattgagtagtatgggatgtttggtgtagtacacatgtggcttggttctccctccttgacagctagcttttaaagacggttcccaagtgcttaggggcttatcattttctaatatcaagaattattgaatttagaatctttattagtaaaattcataatatcacttcatttcttgtaattttagtgtttatcacaattgttaagatctaattttttcaagtataaatgcaggtatgagaaggaactcatgcatcctattcaaaaccttctcaatggagagctggttcgggctatacttattcaggtaatgtaattcatatgttatatcttatatgtaacatctggtttagtagttttaacgtaacttttcactgttccaggttcagaagctcaagctagacactgagacgtgagtttttttaatctgaaaatttaagtaaatatttcacattgttttaattcctcaagataatattttggtcagggcaatgctagagctgaaccagattctacgggcaaatgaaatcaactttgcagttctgactgctttaccggcatttttcctctctcttttacttatgatgttagtgcgtggatggttcaaacaggtaatttcccttggttggttggcacaaaatgatgagcttaaagaagatagtactccaaatatcatactatagtattgaactcttgagaaaaactatatcaactgagttggagtgtgaatcttgtttggagtgacaccctactccatgaagtgattaagtgaatattggtgacaagattgttgggaaagaaaagagagggggtggggggggcggggatatgcttgcaagttacagtatgtatatattgctaaatcttaatctcttcactcctgactaatttttagtgtatgtgtagggatactgttaaaatttgtttatatgtgatagtggactagatattacatcacctgtttctagttacttatgtcttaactattatttgttaggtaaaaagatgttttttgataccaaatctgctcaatttcatcctttgtttctttgtccactaatgttatacttgactgttatcatttttttttgtatagaattttgttatttgcctcgtattgattggtggatgctacagtgttatgaagttacctattctgttttcaatggatttggttactcattatagtttagtgagataatttccaatgattttctaaagtaagttggcttggatttagcatggacagaacttagatacaattccttaggtggtgtttgtgatattctccaattagaattggagttttaccacggtaaattgtttcttttttttgtcaacttgtatcagtaccactacttacattgataaaaaaaaaaaaaaatctgtgtaaattaggataccaaagctgagggaagaggtagagttgctcggattcagaggaggctacttgttatagaggttaagaaaaggattatgcagtaccaaaattatgttgatcaagggttggtaagtagctttcctttttgttgattttatttagttgatttgaatgagatggatagaccaaggatagaaatgtcgtgttacatgttatctacaggagagagatgcacaatatatgtttggattggcactctatagcctggatcgcctgtatcagtctgtcaagtggcacgcagaagctaccggagagtgggaacggttagttgcactcttctctctcaattctcagctacaattgtctagttactttctgtttaacaggctcatatttatatcctcttactgtttaagcacatgaaaagaatgtgatttttttgaatgttgagattgctaaatcagtgtaattatgaacagtttgcgtgaggatataatagatttggccaagcctagactacaaactgcacacaaggaatctgtgatatcacacatggttacatttgactgcttgcttccaagtcggaaccgccagtagcatattttagcttactattcttaattcttttcaatgatgtttctcttgctactttgaaatccaattttgtcgcgaatgtatacacatattcctcgtacatggttacattttatcatcatattatgataacttttgacaattttatcaattgaatacaaatgatttatgaagggataatatatcttcatttgctcgcaaaagtaacttaggattaaaggtaatgttcatgttgatcttcttgcttatgaaagtaagtactctagataacattctcatctccgtttttggctactagtgcaagtctctggttattttttgattggtgttcaatccttttccgtcacaactcagggaaggcagaattgaacatttgtttttttttttttttttttnnnnnnnnnnnnnnnnnnnnnnnnnnnnnnnnnnnnnnnnatattagtattacttttatacaaaatattaataatgttaggtcatgtggttatcagttcatcagttatattgttatttgatatagtggagactaaaaactgttaacaaaatattacataagaacaaaaaatgttaaaaatttaatatgaaaattaacgatagaagaaagaatgtttgcttgtttcataattcaagttatcaattgataatcatttaatcacaaatgtaataacttgcaaattttagaatagaaataaaggattacaaaagaaaaaattattaaatgatactcaaatatttttattaaaaaaaaagaaaaatgtaatatcttcacaataaaatttataaaaaaaggaaataaaatatttgtattaaaaaataaagtttttttctttacaacaaaaacatataaagataattgattattttaaaaattaaataaaaacaaaaacatttaaatatcattatttttaattaaattttaaaaaaagtatctaaaatttaaaataacatgtatattataaaaaaaacaaaaaaaaattaacctacaagtaacctcattagattatttataacgtattttttgtgccttttgtggagctataagtgtatgcaacaaattgtgtttagagttggacaacaattgaatatgatgcttgcccgtatcttgtccatgtcttttcacagtcttctgatcaaatcacgtgcgtgactgtatctttccatacaagcttaaagcaattaagaaataaattaaaagaaaactgctttaatttctaactacaatcgataccatacgtttctcgacaatttatttaaatcactttcaaatatttactttttgattttcttatcccgacaagaaatgaaaaataaatttaaagggaccgatattaattaagaggcagatacaactacacgcacatatcagtaatgtaaaatattgtttgttgtgcatgcgattataacaaaagagaaaaactagaagaaaaaaattcctttgtcaaagaaaaaaagaagcctcaagtatctactgtttgtgacacaagactatcttttccctacgataaaaaaaaaaaaaatagtgtcaataatttttggaattatctcttatttaaactgatgtgaactacaaagcgtggaaaattgagtgcgagaataattaaggtttcttttctattttaggagtgataagtttttagtctcaattttttcagattttaattttcagtccttcaaatttttttggaaatttttaatccctctaattttatttttttcttattttaagttccttgtttatttttagtccctcatttattttatattagagactaattttacgtaataaaaataaatgagggattacaaatgaataaaaaatttacaaggattaaaagtgatgacaaaaaattaatggaagactaaaatttatcaaaaaaaaaattaagggctaaaaattggaagctaaaaaccttcagggactaaaaatttaattaatcgttaattttattgcacatctcgagctaatttcttatcaagtagtttacaaatgcttcattaatataatattattaaatttaatgaataaaaaacaaaaatcagttttaatgaaaaaggtaaatataattatattattaactaatcttttgtagtgtttgttttgccgctggaaggatgaaggagaggaagaggagaatggaaatgtaatgtttattaaggaatattgaacccctaagcgaatacttaaacacaaaacttccaatttaaaaacaataatagttgttccctcataaaccaagggtcaaaatcatctaacaagatgcttaacatgttcatcaattatacatcttgcacctaaagattttaattcaaatttatttatatttgtgtgctacattggtgatatcagaatatttcggttcaactatttttttctttaattttttaagaagctaagctcattaatgagtgaattattcaatctaacatctttccaagagcgttgttagcaaaacttttgcatattaaaacggggttcaaaaggggtgttgctcagtgctcaccctctccagagttaacaccacctagtaataatagcattcaccacaaaagtttaaaagatagaattagtacagagatatatagaaattcatagaataactaagtagactgctttattttatttcttgcgggcaacatagataagatttattacttattataggaccagtctacatatagcaaccatattcaccaagaaacaaaatctcacgcaactacttattgcccttgtgttcagcatgcagaccatcaaagtaaccctgaggatttttctcaaattccttcctcgaaatataagatccatctccacctggagccttcataaccttatcttcagaaccacttccaacattctctttgggtttggggacttcacctttgctaacttcaccactagctttcctatccatgattcaaacttatcacaatagtagagatataatgcacaataaagcttaaaaggtttcaagttactattagctaggatatgactgaaagctagagctggctggctatttatacaaagaaaatggtgaatttatttttcgtgaattgctgatattaaattcctatattcgtttccaaaacgtgcatttgattcatgcataagaccaagaaaaatattaaagcatgcatttgactgatgcttcaattttcaattatatttcacacctttcatgcgaccaattgttgttaattcttactattcttgtgccatttatattcacctttttcacttcaaaactagtggtagctttgtaattatttagaaataaaataaataaagcatgcttatctaaaaaatagtaaataaagcatgcattttcatttacttaagtgttaattgtcaattatatagtggtgagaagatttgggtattttaaagaaaaagattcgcatatttacaagttacaggtgaattaacattaattatatattttttaattataattattatcaattgtgttatataattattaaatagtatataaaacatagaaagacaataattagtgttttcccctatattaagtgccctaataaaagaaagttgaagtttgaaaaaaaaatggtctggtagtagtattattcaaattaatgaaaaagtcccaattaatccattccgtggatgtaaataacattaacgagaagatgatttagatcaacggtataaccacaaccttcggctttaggtttgacatggcagttttacttacaattattgtatagttgttttaatatttcttgtttcgattacagatgaaacaagctatgaaaaaaccgttattagttatgatttgttatgacaatgttccaatattatgatgctaagaaattagtctgtcacaactgacaccaaatgtagctagccaccacaaaggagcaacatataaaaagactttgtgtcaatagcttcatttgcgattctgatttgctaataactattatcattcattgcattcgagctagctactgtatcttgatcaataacatccatcatggggacaaacgagaccctattgagcataagcagaacaattttcagtaatgctacgttcgacaactataattcagacccagacagaaaatttatttactataatatttccattgacatgccatccaagatagtatccgatggcatatggggtaacccaaattatggcgctttactttcaagatccacaataccggtgttggagcttcaaattctcaccattttcgttatcacgcaatgctttcattttgtgcttaggcgccttggcttcccttatttcgtttcacaaatgatggtacatacatacatacatacatatatatatatatatatatatatatatatatatgctttgtcccttctccaatcttaatttgttactgcatgcaggtcgcatacaagaacatgacatattgcacatcatgttaattacacagaaaaacactattatctaatagcataggcatgcatgcatgacattgttatatatgttcttaaggaaaaccatataatatcaatccatattatatatgaatagagtaataaacactcatttattttaaacactccaccaacacctctcatttctttatatttatttaatttctttctaaaacatcataaattctattatatctatatttttttgtctgtctaacagtacaatagatgtccatgaaacaatttccatatagatataggattaaacttaggaataaataaattagataaacgttggggtagcatatataacaattttaagaataatatttatttaattccatagattcctgagatgaaacttcaattcattttacgtgtttaccgaaataaaattatttgtaaccaagtatgcaatatatatgtaaattaatttccaaatgaattggtgcatatgcaggctgggtttgttctaggcccttctctgaagatagaagcattgaccaaattcaaagtgatattgttcccttacgggagtgaagacgtattgaacctagtaacagggattgggtacttattcttcctgttcctaaatggggtgacgatggatttcagcatgataacaaaaactgggaagaaagcttggacaatcgctctttcgtcccttatgattcccactttcattggtctcttggtatgctacagtttcatggggtacttgcaacaagccctaggagagttcgatggaggaaaacttccggtgatagtaatagggcacagtggttgttccttccctgtggtagcttctctcctctctgatcttgagatattgaactctgaacttggacgcttagcactctcatcagcactttccatggatgtgataaccgaagttatgaggggatttggcgctgctgttgtgagtagccttaaactcgattctcacgataaaggtgaaggaaagggacctgaacttgcactcgtcacatccataaaatatgttgttttcatgacacttacaattgtgattgcacgccccgcaatgaggtggattgtgaggactaccccagaaggaagacctgtgaagaaaacatacacatcaatggtgattctcatgaccatattcgtagggttgtttggagtttgggctaaccagacagtgttaggtgggattttactcgttggtcttcttgtgccagaaggtcctccattgggctctgaattggtgaagcagcttgagatgttcaactcatggttccttgttccaatctttgtcacgtgttgtgccatgaaggtcgatgtttccacgcctattagttcccagttggttctcgttgtggttaccactgttgttgttgtgcatttggttaagatgcttataactgttgggatttgccgctattgcaacatgcccaaaacggatggtttctgcctcgctctcttgttgagctgcaaaggtgtcgtcgattttgtcaacgacgtctttctctttgattcatttgtacgtaaactcacttcactatctttttattttcaactattttccttaattttaaaaaactgcacgcatgttaaatatttgtacaatcattatacaataattaatactcattaaattaaccaatgatcaggtgatgccgattgttttgatctcgatgaatcttcacataacacattttcaaattactatatgtattatgtggaaattggccaagaccatgtactcttgaattgaacaagtaaatttttctttcttaggactaatatatatgactaaaaataggtaaacaaaacatatttaaccagctataaaagttatctaattttagttctaatgcaatgcagttaatgagcaacgaaacaatctccatgatggctatatcagtgttggtgttgggaagcattgcacgcattggggtgaaatccttatacgacccagcaaggaaatacgcagggtatcagaaaaggaacatactgaacttgaaacccaattcagagcttcgggttgttgcatgcatccacaaaccaagccacataaattccgtaaaaaatgttcttgacatttgttgccccacaacagcgaaccccttagtggttcacgtcttgcatctgatggagttagttggtagatcctctcccatcttcatctcacaccgtctccaagaaaggcttagctcaggccacaactactctgaagatatcattgtaacattcgacctctttgaacatgacaatgctggcactgcatcagttagcacctacacagccatatctccactacgtttcatgcatgatgatatttgttaccttgcattggacaaactcgcttccatcatcttacttccatttcacataagatggggtgaggatggtgctgttgaatcaactgatgaaaacatgagaactctcaactctaaggtccttgaaagagcaccatgctccgtggggattctcgtgaaccgaagctcttcttcttctactcatcacagccctttaatgaagcaaatagcaatgatctttttggggggtgcagatgatagagaggcactgtgcttggctaagaggaccatcaaagattgtgattgtaacttggttgtgtaccatttagtttctagccaaagtgaggcaaattggaacctcatgctcgatgatgaggtgttgaagagtgttaagggctattatggtactattgagaatgtgtcatacgaaaaggtttccattgatcaaccttccgagaccactgcttttgtgtcggatattgcaaatcgtcatgattttttcatagttgggagacgtaatgggatcaaatcgccacagacagcagcacttgaaagttggacagagttttttgagttaggtgtgattggagatttgctggcttcctctgataccaatactaatgcttcaattctagttgtgcagcaacaacaaatgcccaagtcgtcgtgaccaaagagatacatacatatatactgtaaccagaaacttaattactgattcttttcatagacaaaaggatttcaatgttgtagctcaattttgtaagtatcagcaaaagaaaattttcatagaacacttctgtaaatttcttctgatctcagtgagtcgtcctttcatgcatataacactttttaatagtgattgattggttttaatgggttagtatttgttaccaacttagcatatgggcctaataatatgatgaggtctaataaaagcctattgtttcagaatcttaataacaatcaaggagacctaaactatgcactaacaaccattaaagaggatcacaacaaacacatatcgtgacctcaacagttatagatttcagccgagcaaatcggaaagaagcatcagctgatctagaggtaagttacatataaataagggttacattcacggaaaaaggtacacattctctctactctactttttcattagcactatcagctgatctggaggtaacttacatataaataagggttacatccatggaaaaaggtacatgttctctctactctacttttttattagcattgtgcacacatctcacctccatttggctggtattaaagtgcatagtgatcaatatttctagaggtatttctcccataaataccttagagaaaacttttgatccaacatcaacgtactagcaatcctgctagacattcatgttcataaaaacagaacaatattaattgggtttaaatatgtttttatgtaagtttagtgtttttacaatttttttatcttgaaagtccatttttctaataataatacctataagtttgcgtctttttaatttttgttgttacaactgtggacttataaggattataaatgaaaaattttaaaaaacacaaaattagaaactaaaaatgagtaaaatatccaattgggactaaaattgaaaaaaacttcaactaacaagtatactaaaattaaaaaactaaacttagtgttcaaaaatgaaaaaatgctaatagaaacaaaaaaacatagttaagccataataacagttaactttattgtgaaatattcatcaattttattaatgattaatttttaattgaagaatccaacttaccagttttaataaatatgccctcctaatcatatttttttcaagtcaaggctcgaagttgatacttaagagatcctagcctcaaaccaatgacatgtagagtttttatttataaagaaaactataataaattaaatttaaaaaactaaattagagaatttatatttaattaaaaaactaattgagatggtgtgattattaaaaacagagtaatggtttttgtacaactcactttttcatatacttcattggcaatcatttttaacggactcaaccattactaaaaattaagaatattttaattttcaaaaaattaattgattattttaaaattaaaattatagtattaaaaatattaactattgtgatatttataattaattaattttagaatatacatctataatatttagttatttattttgagactaattaaagtcaagaagttttttattaaagactataatcaaaatccaacatatttcagagaaagaaaaaaaaaaacatatgtaaatctaaaagtcttaatgaattactgaacaacctcgtcctaatggtacaaattaagattcaagggtgtttatagaaaactaggaaaaagaaaataagcataaatcgggaaagcaattcaagtgtagattagtataatttgaaagcatagcattttgaataacaaatcttttaagcagatattaagattaagatgaataagatttattattggagtaagatgttggatttatgtgcgaagatctaatttttgtaaaataactattaagatctgcattcattttaaaaagataattttttaccctctctttccacaaggttaatttgcatctaattcttgtagtatctacaaaaaatgatttaacatcatcaacattaacaatatatttaatccaaattaattaggattagtggtagataaacttaatgataaatcgaaaatgagacaaagaaagagaaagaaagaggggaagagaaaagtgaaaataagacaaaagagagaaaaaataagctaaaatgaaagaagggtgaaaggaagaagggaaaaaagaaaaggaaaagaactaaaataagggaacgactgaaacatagaactactaatgagtaaaccctctaccaaatttatagtttttctccactccgtcctaagacataccgtccgccaatctatatctcatttcattaggtcttgtttaactaccttttcctatatatgtttcggtcgacctctacctctctttgtgtcgagctcttggtaataaacttttattcttacaggagcatccagtggtcatttcataacgtgcctaaaccacctcaatctatgctccttcatcttttcacataccgataccactgataccttttgtcgaatatcctcatttcttatcttatccatcttcatatattcacacatcctcatttccgctatccctattttatgctcatgttgcctatatatttcccaacattctactccatataccaatcttacaactgttctatagaattttccttttacttaagagaaatttgcagtcaagatctcaaaataagatctactattagaataaaaatatgttctacaaaaaatagttcaagatcttaaaataagatatactattagattaaaaaataaaagagatcttgagagtgatgtgatacattaaaatctacaaaaaaaaaatgtcaaaggtctcaaaatgaaatcttctattggacatactcaatcgattcagagtaaattcaaaataagcatccaaaaaagacatagaaatgataaaaagctaattaaccaggacaacttcctaatcatgtttttactggaaatcatttaatttgtagccaattagtaaattcaaaaaataacttataattatttataaatagaaatagaaagaaaaatagaaaaaagaaaaaagaaaaaatggggagggagagatatacccaaaatgttgttttaattaatatatagggtatatatgaagagaacaataaattatcattcatcgtctttgcacttcggatcaccaaattaaaacatcttattaactttgcttttctcaaacatcattcatgaaaccatatatcacactagattgccagattgccagaatacctgtccatcacatcatcattaattaaactaaaatccaaaaccataacaacaaaacaaggaaatagaagcaggtccatagaaaatgcatattatagtcttcaagctttactggtagaaggatgagaagagcatccacaaatgaattatgttcttcccttctgtgaaaactcctgtggcagccacatgcagcacagatcagagctgcatcagtgccttcggatccgcttggtatgaactctgtggtctttgcagccatccacagcatgtccttcaagatgcacacatgattcctttagcactcgcgatatctcacatgcctcacaattgtcactaatgcgttgttttggcatctttgaggcccatttcttcccatgagaaccatacttctcatggtatgctatcctccaaaccctgcaaagttgttgtcaaaattaattgttagtggataatcaaaattgtagcctgagttacagagaaatcataaataaacagagagatgattaagagagaaaggcagtgagagagtacagtttattgtgtaatgggtatgaagagccctaaccctagaagatatattgaaattgactaagtccgagctgtgccaattttgaattgtaagtaaatgacaaaagaacatctcagaaccattcaatgtaatattttatttctttggacatggaaatgcgcgctagaattttatatttttcttatgtttttcattaaagccagaccagttagaggattgattcttaagttcgcttgtatgaaagaaagaaaaatatagagaaagttaaccttttaaatagatattaatatttcaagaaattagtttttacctatggtcagaaataccttggttgattaaaaaatctttagtgatatttttttttcacatacacgaatttcaagatcaaactaatgaatatttttaaagaatttaaataaatttcatttggatccacacagtttgctaaatggtaaaaaaattaccagttattaattttacaattatttcatctattttttgttgatgtacaaatttttaaaaggttgaaaaatcaaatatatttaatgtaaagataaattaagttttcaacattcatccgataaatgtaagatttattgaatcaaataattaaattataagattttaactttatataaaatggtagttgatttatgattttctattgaaattttttatataatcatcttcaagtgaaatctattcttctaattacattgttttggaacttgaacatgaaatcttgtttaaaaaattagagttttacttcattcaaaccaacaatcacatgttcatcttaccttgaatatttttagtttttaggttaatcaataacgctaatgtatgtttttattcaaagttacaacatatatatttaaactaaggtaattaacaatattcatgatttaaacattcaatcattcaattttattaaatatttaatttaattaagctaattataactaatatatattttgattcaaattaattgataacattaacatatattttgactcaaagttacaacatattgaattaaggtattaacaatatttttatttgaacattcctcatacaatttaacactcaatcatttttttaatatttattattatcaatgcttttttttttggaaagaccttgcgagaattttcttctactgttgtgtgttctgatttcgatttcattgtatttgataattattttgatcgatttagtttataagtggtatttttttagaggttaaaaagtaatgattttgacaaaattttagacaaagtgaattttaatgaaagatcgaaaagggaaaaacttgtatacaagaccaaaaaagagttacttaagatgacatgaaaaacatattttcaaactcataaatttcatacatatcacactagatttgaagaacatcaccagtccattacatcatatcattaagcgaaaataaaaaaccataaatttaaactagacaagcaaattaaagcagatccacagaaaacatataacataggatagatttagatatgatgaagaagaattgttcagcaaacacatagaacacatgatcgaaagtcttcaaagtcaaccagaactggtagtaggatgagaagagcaggtacaaaccacttgagtttgctcttccttcctgtggaagtttctatggcatccacatgtagcacaactcatagctccgccggtcccttcggcgccactggccacgaactccctgcagccatccacaacaattcctccaattctatatgcaagattcctgcagcactcgcgatatctcacgtgcctcacaatcgtcacagacgagttgttcgaacatctagcacttccatcgctgcgcaagaaaactctcctcattgtatgctctccttcttcaacttctctacctacaaagtcaagattgttagtggagaatcaaaattgtagcctgagttacaaagaaatcacaaatagacaaatagcaagagagagagatagagagtgagtacagcttattgtgtaatgggtgtgaagagccctaacccttgaaggtctatttataaagggaaaatcttatttagatccatttttaatgtaattataaaagtaactgacaagagaacaaccagaatcacgtttttactcctttcactctatatcatcttatattatagtaatactaattaattacattttattttttaagacatgggaatggtagaatttatttccagactagttagaggattgattcttaagtccgctgtatgaaaaatctcatatttatggtaaatatgtattctattgataagatgtatatattattaaattaccttaaaagctaatgtaatgaaaaataatgtaatttatggtaaataaattcaacatcccattcattgttttattgtcaaaatataattgtttttttactttaatccataaaatatataattatattaattaacataattatcacgaacatatattttgatttatattaattaataacatcaatatatatttctattaattcaaaattacaaaatatttaaattaaggcaattaacctttgtcccttattcaaatggttaagtgttcaaatgttagttgagatgacattaattatataactcaaagataaaaattaaaggaataacatatgttcaaaaagtgttaatatgaaaaaaaaaataaaagattaaagtcaaaaactgattcaatcaaaaccactttgaatttgattggataagaataaaattttgaaccaattaccgattagataatgaattaaaaaagttaaaataattgaaaatcgatccccaaatactatttgactttatgatactcggtattattttttactttctcataaatattttttttcatagacaatcatgttcgagatatggtcggatacaaaatatgaatattttttctaatgtgaatactaacattggttcggcgcgatgtttgaaactattttctttcgttagacccaaccttcattggttattactaattttcatttaaataagtctaataattaaaactagtcaaaattagataatatgggtttcccacctattgtatttgcatctttgtgcacatcctaaatttgcatcatcattctctatcagaatttcatcgtctccaccttactccttggtgtcgtgcaacaagtaatttaatcgatgttgtatattcgtataaattatgacattgttgaagtatatttttactacatagcttttatgcaactctcacccaagtatatcttttgtaatacctaattccatattcgtgttcgattgtcacaagattttgaatgatgaaattctccttgtctcacaatagaggctcttgctaattttctaacaatttatctctatgtgatatttgagaatatgagacccagttgccttttttatacatttgttgatcaactccaccctgtagtgtggtttttttaacgataattgttgatccttgttgttgatatccttgtaggtttcaaacaaaattattccttccataagaaatatatgtccaaatttagcaatattggcttagtaacaattgtttattagtttgggccaacttttttttttggcttaaaaattgcttaattttttttaaaattaagatatcttcatattaatagtcaaaaatcttgagactacgaggaaaaagtatttacctaccttactattttgtaaatagacaacctaaaactttaatttaatttattctaccttgatccttaattaaattttatcttttttgaaaatagattccataagctctaatttcgttccaatttattcttaaactttatcctttttgcacacaaacactttaatttgaatttcatcttaaaattttctcttttgtaaatagtcttatattaatttggggttaaactagtaacaaagaagaaatccaaaccatttatttaatttaaatcccaatcatttactaattatatgtttataaatcattttccaaatagcagaatataataaaatatagaattaaaaaataaaataaaggttgtttaattttttttctttctaaattcctttttttttattatatattaatatactaaaatgaacatgcagtatcacaaaagaagaaaaatattaatcaatgattgacatttaagataaataatttaactcaactatgatagaaataactatatgtaaaaaggataaattttaacaattaattagaatgcaattaaggtttaagggtttctatttgcgacggtaaaaaagtttaaggatcaactgaaatgaaaataaagtcgaccatatatttgcaaatagggtaaagtttaaggattaattaggactaaacaaaatatatgttaaacaaatttaagtatcagttacaacagataaaattcttaaaaacttctatattattttttaataatagtttttagaagataaaaaaatttaaacagaattttacaatgtcaatatatgttaaaaagtatttaataaataattcaaaatgtattcaattaaaatattgttgtaattaagtatttaaaatcttaactccaaattatttaaaaaaaactgaaatctaaattaaattgaaagaatataaattatcaatatttaagatattaaatttatttaactacatcatatactcaatttagtaacgttcttttatttcatgtaataaaaataaactatagttaatatttttaattttctaaaccaagtaatttaataacaaatttcgacctcacaataaataaacataatttataataataggctacaaagattctgcaacctagtatatacaattaccaaaactgtttctagcatattaatatatatacaattactaaagataaacaggacaactttcgaacaagtatttcattttattttttgtgagtgtgtgtgtggaaaatgaagtatttcaggttcatatataggggtgctaataaatatgataaaaaagaataacttgtcagtttttatattcgtgtgcctaaatctggtgtgctttaatagtactaattatttttcattatttgagtcttgttaataaaaacaaaattatgtattaaaaaaccttgtccaactcttctattttttactgcttgtttaactcttctttaaaaaataaatcaatttgaacacgtgagtttttaagaaactaattaatccctagccaacgagaagatcgattaccatttggaggacacagtaaaattaaaatggttcagtaaatttcatctttagcttgaaataaataagccatatggcaggcttaggctagctttcacccaattcgtgatcagtttcaaggcagttttagtcctaacacacactgtggaccaccaaattatagtaaaacacagtttttgtgagactaaaactaaacgttacttgaagtagcacagagtttttgtgggggtgcacagataagattccactaactattgtctctatgtgaagctcttgaactaaaacgttacttatagtaaaacatagtttttgtggggttcacgcatataacgtatgatgccacagaggatttgcctatatgtgaggatctttgccttaaaacgtgagcatcattggtaagtttcatttgcccaaccatccaaagttttccgggaaaccggcatgtagagagcttttaaacctaaaatccgacatgcatgagaatgaatgagcatctttgtggaaaccgatgtaacaaattcatcgaactgaaatggttgttgttcgaaaactgtcttcatgtgaaggttcttgaccaaaaacgtgagcttcacagctaagctttgccaaaccgtcaagtagctcccgaggaaaccgaagtgattgttcgaaaactttacctaaaacgtgatgtgagtgagcatcatatagtaacgtactgctaagattttccaaacgcatgtatcaaattcaaaatgattccttcttttgcatatagacgttttattatgtaagaactcaatttattagtaaatgtaataaatacttgttcagtaattgtatgctaggaaaaaaaaatacacgactgtggctatggcaagccaacttgtttagtaattgtgacacatgaaaggcccgatggccgtgcctatggctgccaacttccatagggttcatttgaactcttaattttgagtataaaatcacaaaaaaaattattcggtgatattttattatattatttgataacacaatttaaaaatatgtttatacatagatattgtttaaaattatttgacaagctagtttaattattactcatttaatattaaagttatagaaatttactttatagtatttactttgaatctaaacaaaaaaaggcattgaaatgaataataatatagggattaaatttcataaaaatattgtgatttataaataaaaatgtttgatgaaaatgatagtgatgaaatcatacattcagttaaatattaattcatttggttcttataaaaaatttaattcctttattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatatatcaaatccatttactttattttgttcacagcatatatgtgtgaacaaatttaatatatgaaatcaccttgcatttttttatatttgaatctcaatagttgagaattttaaaagataattaattgaaagaaatattattgcgttaacattgaaacaaaagaaattcatgccctattagaagtattacatttttcaaaaattattctattttacatgcatgtaatgttttgcagaattttattaataatattttcaattgtgtttattgtataaaagaatttaaaattagaaatttctagattcaatttgagataaattatgttgcatgatagtaatcgaatgaattgccattaagtgagacgtagaaattgcttgattaatacactttaattaacagtaaaatactacaaaaaaaattaatgccctatatattagatgtattaagctacattaaaaaatgatttttttacatgcatgcaatatttataaaataataatacttgtaattattgtcattgtcaaaagaatatcttaaaaaataaaattttatacattaaatttcatcaactataatgcaagatagtgattgaaagaattaaaattttgcttgattattaaactttagttaacaatttttgcaatttaaaaagttaaaagaataaaaagaaaaggggagaactatattagactaggactcaaatataaaaattacttttaaacttcaaaatggatccagatcagattagtcattatgtatactccttttattattgttagggctcttcatacccgttacacaataagctgtactctctcacacacacactgcctctatctctgtctctcattttttctttctatctgtctatttatgatttatgatttgtttgtaactcaggctacaattttaattctccactaacaattattttttacaacaactttgcagttgaaggtagagaatttgaaggataacatacagtgatcgagatgcccacacaatccattatatagcgagtgccgaaggaataatgcgtgtagggttggaagatatgttttggatggctgcagggagttcgtagcaagtggtgcggaaggcactgatgcagctctgacttgtgcgacatgtggctgccataggaacttccatatataggagggaagagcaaaatcaagtggtctgtgattgcaatggagcttgaagactatgatgtgttttatatctgcacaactatatgtaaaccaccctatgatatatattttctatggatatgctttttcttgttctgtagttatgggtttcgattttatcttaatgatgatgtaatggacttttgttgttatgggtttcatgtgtttgcaaaagaaaagttcaaagttgacaaataataagttttattttggcatgtcatcctctactaacaacacattttaatccaattctttttcgatctttcaccaaatcttgtattgaaatattagaaagcatctacaaaggtgttgcataaattttttatttaattttgctgataattacaaaaatgagctacaacattcgaatccttttgtataataaaaggatcgagcagtaattaattaactttttccgattacaatgtatatatatgaatcgctttggtcacaacgacttaggcatttgttgttgttgcacaactagaattgaagcattagtattggtatcagaggaagcaagcaaatctccaatcacacccaactcagaaaactctgtccaactctcaagtgctgctgtctgaggcgatttgatcccattacgtctcccaactatgaaaaaatcatgctggtttgcaatatcagacacaatagcactggtctgagaagattcctcaatagcaatcttttcgtatgacacattctcgatggtaccataatacccctgaacactttttagcacctcatcatccagcatgaggtcccagtttgccacctcactttggctagaaaccaagtggtacacaaccaagttacaatcacaatctttgatggtcctcttagccaagcatagtgcctctctatcatctgaaccccccagaaagatcactgctatttgcttcattgatgatgatgaagaaaaagaacctcgattcacgagaatccccacggagcatggtgctctctcaagtaccttagagttgagagttctcatgtttccatcagttgattcaataccaccatcctcgccccatcttatgtgaaatggaagtaagatgatggaagcaagtttgtccaatgcaaggtaacaaatatcatcatgcatgaaacgtagtggagatatggctgtgtaggtgctaactgatgcagtgccagcattgtcatgttcaaagaggtcgaatgccacaatgacatcttcggagtatttaatgtggcttgggatagccctttcttggagacggtgtgagatgaagatgggagaggatctgccaactaactccatcaaatgcaagacgtgaaccactaaagggtttgttattgtggggcaccaaatgtcaagagcgttttttacggaatttatgtggcttggtttctggatgcatgcaaccacccgaagctctgagttgggtttcaagctcagtatgttccttttctgataccctgcgtacttccttgctgggttgtatagagatttcaccccaatgcgtgcaatgcttcccaacacaagcactgatatagccatcacggagactgtttcattgctcattaactgcattgcatgaggaccaaaattagattactagctagctagttttatagttaagttaaacaagtatttacctattttaatctatatctctttcaatattagccataaaaaaaagataaaattattgtaaaattcaagatcatgtattatatgaagattagtcgggatcaaatgatttaatatcatgtgatctccacctatctcattctcattaagttaatcaatattaactaggatcatatagtcttggactatatacaatacagtcatttttctttaaataaatataaaatacctaaattaaagaatattatgatataagaattcaattaatttttttgaaaaagaataatttaatttattatttttgtgatatatatatatatatatatatatatatatatatatatatgagaaggaaataaagttattctaatattttgtgtggtaccattgaatcaaatagaaagatgtgggtgacgtagtcaacgacacctttgcaactcaacatgagagcgaggcacaaaccatccgttttgggcatgttgcaataccggcaaattccaacagttagaagcatcttaaccaaatgcacagaaacaattatggagaccacaacgagaaccaaggtgccactcttaagcgtggaaatatcgaccttcatggcacaacatgtgacaaagatcggcaaaaggaaccatgtgttgatcatctcaaactgcttgaccaattgggagcccaatggaggaccttctggcacaagaagaccaaagagtaacatcccacctaacacagtctggttagcccacactccaagcaagcctgcgcaaagggtcatgaggaacacaatgtacatgtatgctttcttcacaggtcttccttcttgtgtgttgctcacaatccacctcattgcggggcgtgcggtcacaattgttaatgctataaaaatgaagtattttgtggctgtgtaggctgcaagttcaggtcccttcccttgggaatgatcatgagaatcgagtctaaggctgctcacaacagcagttcctagtcctgtcacaacttggcttatcacatccatgacaagtgctgctgagagtgctaagcgaccaagttcagagttcaatatctcaagatcagagagtagagaagctaccacaggaaaggaacaaccactgtgccctattactatcacgggtagctttcctccatcgaactctcctagggctttttgcgcctgtcccatcaaagtgtagcataccaagagaccaatgaaagtgggaatcataagggacgaaagagcgattgtccaagctttcttccctgttctcgttatcatgctgaaatccatcttcaccccgttcaggaacaggaataatgcgtacccaaaccctgatactaggttcaacacgtcttcactcccgtaagggaacaacaacactttgatttttctcaatgcctctatcttcagagaagggcctagaacaaacccagcctgcatgcaccaattcatttggaaattaacatttttattgcatgtttggctacaaattatttcatttcgatctatattaacacttacaaggaattagtttcatctcaataatctatgtaataaataaataatttatttattcctaagttcaatcctatctatgtatagtatatggattgatattatatgatttttcttaaaaaaaaacacacacacatatatatataacaatgacatgcatgcatatgctattagaaaatagtttttttataggcaaaaaatatatattagtaaagatcaaatgacataaaaagtgtcaaagtttggccaaaacagatacaagagaacatatatatataaaataaaaacatgaaagcgcctctacctaaacacatacgcaaacatgaaaggctattagaaaatagtgtttttctatgtaattaacatgttgtgccacaaatatgtcatgtggcatgcatgttcttgtatgagacctgcatgcagtaacagagaggagaatggacaaagcatatatacataccatcatttgtgaaacgaaataagggaagcctaggctcctaagcaccaaatgaaagcattgcgtgatgacgaaaatgcagagaatttggatctccaacagtggcattgttgctcttgaaactaaagcaccataatctctgctaccccatatgccatcggatactatcttggatggcatgtccatggtaatattatagaaaaggaatcttctgtctgggtctgaattgtagtcgtcgaacacaactctactgtaaattgttctgtttatgctgaatagggtatcgtttgtccccatgatgatggatgtttcaagattattgaagaacgaaatacagtagctagctagaatggaatgaatgataatcgttattatcaaatcagaatcacaaatgaagctattcacactaagccttttttatatattgctcatttgtggtggccacattagttggtgtgagttgtgacagactagtttcttagcatcatgactttggaacattgtcataacaaatcataactatatatataacgggttttttagtagcttatttcatctaattaaccgaaacaagaattacaaatatacataacaagtcaaactgccttgtcacgcctaaaccacaaggtggtggttataccgttgatcagcttctcgttaatgttatattcacattcatggaagagattggaacgttttttattttatttttcttcatttgaataatattgccagcttatttttttttccaaattcaattttcttttgataggacactaaatatgggggaaaaacaacaaatagttgtctttctatgttgtatatacttgtatacacgatggataggtccctttttaattgaaattgtccaatttgatctcccaaatttcaattgagtaaattaggttctttttaattgaaattaaatggatgacgagtaatcaaattaagattgtaaaagaatttttttattaattgaacaaattaatgtcaaattaaagcaagttatcctttctaataataatcaaattaatcatgatacaaatttgtgtcgtaattaattcaatttttatttatttttactaaattcaattgctatgaaaatataattttaaataattattttgattactattataaaggtaatttatattctcttttattgaatttcaattaaaaattttatatcatacttaatttggctactataaaaatcataaattatatcataattaatttattttcaattagaaaatatcatttacatcatcattaatttgattagttttaaaaaaataacttacacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaagtgaccgggtatacttagcaaaaaaaaggtgtatttagtttacaaattctacaagtttcatatgttaatttttttaccaactttctctttatataattagagtctaaaataataatttttaattaacttttttccaaaaattaaatattttatgttaggtgggcccatatttagattatgagtcttactaaccagtatttttagaatattgattaagagattaaaagaaaaaaatatttattatgaaaattataaaagtgtgtaaaaaaagttataaacaataaaattttatatattttaataaaaatttctctttttaatttcttaattaatatcttaaggatattattgatccatattggctttcgagcaatatttagatcgatattaaattaattctatattcgagaatttgcattatatatatggtcattaactttctctatataatggatatatgtcacagtataatatacctgttcattaattaaatcaaatcagcattagtttccgaggcagtcatgtaatttacgccgcttaaaaattgcggacactaaagtctacattgcctacactcttcaaaaaaaaaaaaaaattgtatacatttgtgatcaactcatggctaattttggtgctaatattcaaaaccaaataaagtaccagtttatttaaacgtatggttaaagtaagtgtttattttaataaaataaataatttttttttttagtgtgtttgtctaaaatattgcatttattttaaaaaaattgtgcttatttaataaataaatcttatatatttctttaaaaaatatttatataaaaaaatacttattttaatattactttttaaatttaaacaaaatcacccaaaataaagacgtgtagctgtgttagataaaactactttcattacatcatagataaaaaagatattaaaaaaatgacacaacatcttttggggtgagtttaatttggttgttaagaagggacagggaattgaagataaatttttactatttagtgtgtctcacacctcttttactctaattcaaatttttttttctattgcatttcttttcgtatttcacctatttttactcatctctcttagtctattctctatatttatctttaatcaaacatcttttatttctagtttttttttcttcatcgactctatttatcttctctatagtaaacaggacaagatacctactacaacaaaattatctgttatctaaaaaaattataagtcttataaccaattttgaaaaaacctctgtaattaatatgtatcatcttataaactcaagttgatcaagatttaaggaatgacaatattcattctcataagagatctctcacatctcctagactcttatttcttctgcttaaatacacaaccccctctatcttgaagtgtctcttttttcagagacttatatttatagcgaatgactaactaaacaacttcttagatactaattccttaaactcatatataaacaaaaaatgatcttgtatgttgaaattaatcataagtaaatctaactaattttatcatatttaatgttatcatttataaaatagtattcatttaactctaattatatttttaatgactcttttatatttgataataagtttcaattaaggatattttaaaaataatcttattttttaaattgagattagtaaaactaaataatattaactaattttcttaattaatgtaattagtcatttttatttatgagtcgaaagggagtaatacaaactaattactactttttacatttccaaggccattgaaaataaattttctaacttccaaagttaaaagtttttctgaacttctccatgaatcagacataaattccaaaaacaccattttgtaaaatgcatgggaaacaattgagtttacaattttgaaatatcattccttacggcattaatttcagatatgctcatcattgaatcatgaattacaggtattttggcacaatagatgtgagtctaggagagaaccttctctctatggtcgaactctgaattgcggatgtatagcaattactaggaagatgcactttttgtcttaatactcagaccaggacaggcacaaaactttgtagtgttttcatgttgttaatttggtacgagcaaacttccaaacttttcaatagaactgtttgatttataccagcaggcgcagcaggctaatagaaaccacacacatgacacgaccctaaaaagaagccatagtcaattctcaattccggaatgacaaagcaaaaccccacctcttagataaaataaataaaaccgaccacacacaaagtttgaaggaaaatgatcttttatctcacattaaaacagcactagcttgtcatgaccatcaattaagtacaacaagaaagtttcaagagagagcacaagccggactgcagcagcatatgttcactaaaatactgataatagcacataatttgaatgtcaacttgatctctcaagatacataaaaattggccatcagaactcagaaagtaatgcctgcttttattaatagctactttagctagtcataacctgctacaattcttcaatcctgcagagaaaaagataatagacaaaagttatggcacaaccaaatacaacttatgcaagaagataaagaaaatagattgacctgcttagtcacattaccaagagttagtttagggaagcgcagcacaacttcagataaaactttcttgcatatatatagaaaatttaagacaagaaattgttcactaaatctattagctttccaactaagtggagataaagttttacaatacttgattctgaatcatttctattatattgaaaatatgcaagacattgacaatggccatatatgttaattgaaagcaagctccccaaagcaatgtaacaatactcatatgtctagtagagaatgattgtgttggtatctaaagttccactcagactgtgaagcctgggatagaggaagatattgccaccagtgtttaaaagaaacttccatgcagtttaccttataaacatatatatgcatgcacaacaacaaataaaaaagatgacattttgttatttatgattaatgattgtacattcaaatgcattcaattcattaacctgcatatatatgctgatatgcatagttgcataccaataccttgtaattttctagagaaaatggaaaacaggatatgtagattatcatacctcatcatcgtcatcgtcatcattatcacgatcttccttctttttcttaagacgggtagtaccactttctttgctgatgggtaacttcattgctccaaagggagtatcaacatcaatatgtcctttcatggtgtaacctattccccttcctctaatcatgtcccagagtgcagagccaaaatccttaggcctgaaggtaattggaatatcaatataactaattccacttttctcaattttagcagacttggtgagttctgcaccaccaatgctaacatcaccaagccagacctcgtaatcgagcgcattgaggccaaggtcgaaatcattcttgttttccaacttcaaatgaagagttgcaattgtctcttcaaaagagaacctttcaaaatgaatcttctcaagatcaatatcaggcttgtatggtatggggatttctccagttttctctaaaggtagagttagccttcccaagatgggaacatcaaaaatgagactaaccttcaccctataaggaatgatgcttccaggtttaatatcagcatatgtttgcttgatgtcatcataaatcaaagtgacaggaattttgacagtctgctctccatgtgcatggatggtacccgcatccggtatcattccggaaactagcttcctttcatcactgtcaaccaagtaatctatgtcaatcagagggattggcaccggattcgggttcttgatgagcacatcaacaacaagatctgccttgtgaagattaatcgatggaatgtgtatcgcagtaacgtcagcagttggcttcccaaacccaatagcttcctcaatcttctcaccaatgtcatgaatgaaatccttcaccttctcaatgaatccacccttcccctcctcttgatcatcttccttgtgcttttcatccttgctacccctttccaccacttctggcttatcagatgtcgacatatctaaatcgcagatagtaaatgcacacaacagttagcttgagcatgacccaatcagatcacacaaaaaatcaaagttaaccaaagagtcacaatttaactatccgatcaattatttacaaaagaaaacactgtaacatgctggatcacttgcattagcattaaatacaaatatatcattcaaaatacaaactttagatctccatgctccaaaaaatgcagcaaaactcatcattccatataagggtagtactattttttttttttttatataattactttttgtcaatggatttcccagtaatcaaaatggaagatagacagaatcatgaggtcaatgcttgatcaattgagtagaatataagataccaactctacaaaaatccaaaatgaagcatggtctaattggcctaaagctgaatcatacatatagtgggaataaagtagaaacatgagaaagagagtagagaagtacctgaaaagtgagatgagatcagtgatccaagtgaaaagagagagaatataactgtgaatgtctgaatgagattaacaaaacacaccaccactccacaacagcagagagatcaagattttgtaggggggaaataattaaataaattataaaaaatacaaaattgtaaaaaccaatatcatcaaagtcttggattacatcaagggtcagacatttgctacagagacatgaaggtagccgttgattgaagtcagggttggtttgaccataaaaccgaccattccactctgtaaagcatggtccacacggaatgcacatgtgactgccacattgtttattgtttgaatagacaccgaccaaccactcactttctcaatatttcaactttattaacgttacaattacaaagttaagaagaagaaaaaagtctatatttgattaaaaacttattaattattgagtttaaattattgataattaaacgacttaataaaagaaaagtcaaattttaaatatattgtcaagttttacaaattaattaattgataaaaataatattatacaaacaaatttgaaattcttttgaagtaaaataaaaatataacgattactcattcacatatgtcaaaagagacacgtcgactcatttttttatttcgaattttaattaaacaatcctcactattcaatattttttattatttcaattaaaataacataaaaatgaaggtctggaagaatgacagatagaacagaaatgttctgtttatcgctacctacaaaaataatttttaatttaatcatttaaaattatatgaattattagtatattggtattttaaaaattaagtttaatcgtcatacattgtgaatgtaaaattgtggtttgactgtattttatacctccaaagttacacaatttcgcaaattttgcctcctaaattatgttttcacaaattttatgccagtgtagtttaagacaatttgtgactttttgtaaattttaaaggaaaatttcacacacaaaaaaaaaaaatatgagaacaaaattcgcgagaaaacactgcagctaaacctaaaattttatatactaatgttgcaatattcttaattttgtgtatcatttcctattttgaaatgcaaatactaacttgtattcgattcagataaaaaaaagtagaccttagaaacacattaattagaaaatttaattaagataaaaataaaagccctaattacaaattaagaaattacaggtaatatcaacaatattaactatctaattaaacttgtcccgtttgattttaattaagctaggttaataaaaaaaatattttattaagtgggataataaggaattgttaagcttaagtaacctaaattaggattaattttatacgaaatttttattacaaatagtaccaaaaaagagattttataaaaataatttattaatcaaaatttaaataaataaataaactaattaagtgatgcatataactttgaaggaccaaagtaaaccactttgaaggactaaattaaattgaaagattaatttggtaacaaaaaaaatgacttaaagaagtgacaaaaaagagttttaaaaacttaaatttagtaatcaaaatctaaaaaataaaactaatgaagtgatgcgtataaatttgaaggaccaaattaaaagtattctctaaatacaaagaatttttgtttttttagttattgtagaattggaatagatgaatatattgatttttgtcaaaaagatgtagtgtgtttaacaagtaactttagttgtttataagctgcttgattaacttataagatgttttttctttttttattttagagaagaaatttagaatctcactgttcattgatgagaaattttagagctaatagcagttagcttccaattaacattacacacacattacaccaaacaaataggtcaaagtcaaaggctaataataatatattaatccgactttaagatttttctcttctgctatttctttttctttttctttttctttttgttattgctgagaattcctaatttatggataaacctcatttaccaaaaaaaaaattatggataaacctcccattcatatacagttgtaatggtacgcagcgaggcagtagacaaaaacatttatattttatagtatcttggacactacattggattcttttgaggtaaatctagcaatatacattggattctcttatattatattacataatgagggtagattcacatattgtcctgtccacgaggccagtgtccatagaccaaatgcaatcagaattctcagtaaattgtctgaattgtctgtctttcaaatacaaccaattagcatctcaaaaacttcgacatggcagccacggattctattataattataatgtaacctaaaacttacgagtcacaaaggcaaataaaaaaatgccttggactgatgaaacaaaattatctaaatgattcagaccacaaggtatgaatcattactaacttaccaatatagcaatgtagattttactgttgaaataacacttataatacaaggtagaaaaaactcataattacaaggggggaaataagatgtaaggaggctcatcatgtccccagaggagctctgtcatctggtccagcaagcatgatctggcattatttgcatttgcaatttagaaatggtgacaaaaaaaaaaataagagaaaagttgaattctgaaattctagcatatatttaagtttcagaaagacatacattacagtcaaatgcaaatctccttgcaagcatgatggcagcattcctttctctctctgattcaaaagctaatacaaaagaatgtccctgctttggctgccaaaatagtgcttgtgcagcagcatttccacctccgcgaactccacaaagctaaagaaaacaagatcaaagcacaatggttgaccaaattccagtttatcataaatgacaagggaggataacacattccaaagagcatgaaaacatatgcattttcataaacatcaaaatggcttcaaataattcttcaatgcacaatgttagttaaactatgtgcaagaaagaggttagaacattgttttgctagtcaaaatcaaaatatagatatcatcaactatttgaaatacctgcattgaacttgaatagtattctttggcaattgttgtctttcctttacaaagtttaatcctcatctttccaacatgaagcacatgaatagattcagttggatgatgtgaaccattcatctgtgttacaaccacctgcaaagtagtaaatgcaactacaatattattgtcacataatctgactagatttgccttctaaactttttatattggaatgtggagaaaaagtacaagacaacagcaattcgtcaaaactaaacactacttttaaaattttgattacaagactgaagcaagtcagcaacaacccatggaaccatacatatttcagtcaaaaaacagctccatttaacaagtctttcatataattatataaaagttaaaaggataagagcaacatacgttgaattcagtgtcatgtttgcgcactagtgcctctacataggttcccaaaccagcagctgcataagagtacgaaataaatttaagctcgacatgatttcagaacacatgcttcaatctcttaactgataagaaaaaaactttatgtttgaaatagaaacaaatatatagaagcaatgcctgtaagtgactactaatgcaaatgaggacaactcaaattgaaaccagacctggatctattggaccagcggttgaaagtgtgacgtgctcgctttctgaaataatatcaacttgcaatatgcgtccaacatcaaaaggttcaggggcataaactgttttggttgctcctgagaaagttgtattatatgataagcaaagataaaaacaaagaactaattggatgacatgtttaataacaatcagccttccagtatcttgaacagaacaacttacataataagccccattgacagttaagattctgattgattaacattatagtataatagccacaaaaagcaagtcagatgtacgaataaaaaaatcattagtatatacaaaaaacaagcaatcagtttgaacatacatctatgatgaaaaaagttaacaagtttatcagtaggtgagggtttgagtgctgccggtatgtcatttataattttctacaaatactaaggatcgagttgccgtcaccaaaactgttattcacattctgcccccgggaagtgacataataaaaagtgttataccagaagttgaaaaatgcataaaccaagagtcaattgacttgcatactaaaaagaaaaagaaaaccacagaaacaatacctgagataagttcttttttggcaccatcagatgatacacgataccactgaattgaacattttgaaacttcaggggcattatcagagcaaggttgaatttgcaaataagaacctaacgtttcattcccttcaagttcatataaatgtggaacattttccccacctttcttcgtccttgttaactgaacagtagcatcaaggataatcagtaaaagaagattacaatggtcaatggaagacaatcacgaaagtcctccatttaaggaaagaaacttaacattcacttaagacaacaatatagtttaacatcaaatcccaaattctaattcttattcatatcattaaaaaccatcatggaattttccatcacaccgtgtaagacattagaagattcccccaagtctatctaaagatcatatacagcagcaaaggaatatgaaaattcacatgtttgatgtttttcatattgtatttagtttcttttttttttttacatcactaatagaaaaataaaagaaatatgaaagaattataggaccatattttcagtattgccagagaatttaacagcatgaaagtattcgctgcatgacctgaagcatagatgacataaaatgccccaatagtagtgatacacacacaacaatcgaaaaagcatattatccacataatctgtgcatgatgtcaaaccatgttatgaacacggattctcaaccgccaaaccaaaaaccaaattgaagttacataatgtgattcatcataacatgctacttaaaaaacaaacagcttaaagtcttccacataatgctgagaaaatatcaaagaattgaccatggatgcatttcacaaaataatcttttcgacatggcataagatgacaggcatacctccttctgaagttgaagatactgtctagtcttctctgcaagttgagccctcaatgcttgaagctcatgttccatatccatgacctatatattaatcaacaatcaatgtattcatcactttgaaataacttgataaaatgttaacgacaaagaaaaatgaagtctaagaaaataaaggtaagaaagccaataaatggaacctagaaaaagagaaggcatttgaaatagcagatatatgagagacaaaatagggacatgtgttcaatatataccttgcttggctgatgcagcattttaattcttcgagcctcttgaacctccctcgttaattgctccagatcctaaccatagagccaaatgttattcaaatgattattactaacaatgcatagaaaggggaagcagtagctcaagggtatcacataataacaattgccaaaagagtaagatgtttagtccagggctccaggctttcaaggagaacagaaaactagaagggagggaaaacataaatgcaagaaacattgaagaataattttaaaaaataaaataaaatcttaagcataatttaaaaataaaaataaaatcttcagaatatgatatttaagtcggatgcacttatcattatggcatcatgaattactaaattccccatgataaaacatgacaaatgacaagtaaatatcacctgtttcccagaagcttgagacattctctcatgttcttgaagtgcctcttccactctttgaactgctgctctggcatcctctatttcagcacgagcaaaagctctttcctcatcaacaagtttcttagcatcttcagaagcctataaattaatataaactctcagcattggtaaaggaaatttctttatgcaggcatataaagaagatataaactaacaacatatttctttactcctttcttctttttttcctatttctaataaaacttcttccatcaccacataaaataagttaattcacctgcttaagaaaatttgcaagcttcttcacctctgccttctcttgtattagttccccttccctctgagtcaactgaactgctagagcttcaacctgaagaatgcacaaaataagttacagttgcatctcttaaaaagattgcaaatgcacaactaaactagcaccaggatgaatattccattaaaaaaattaaaattatttttctgtgattgaagcaatgaaggtatttagtattatctagataataaatttttcttctacaagcttatgcaaaatttagtaaaaagtattcccaagtttattctcaaagcctttccattccccacatacacactcccaatttgacttttaaagagaataaacaagaatttatatttatactgtcagcttcatacagaataaatatgaacatatatctgttagatagaaacaaatgtgaagtatatatcttctttaaaaaaaaaaagaactaaccatcgcaatagtttcttctacatcatccttgtttctgcctgccacacgcccttttaaggattcaagtgcatctctaagcttcttcaaaagaacatgtttttccaatgatgctgcctctctaagtctagcctgaacttcaccagcatacaaaaagctagttaaaaaagggacatcagtttattagaaaactatgaatatgatcattggttatttcagttgcaaacattttacaataagaatctcaggttgcaaaaccctccaaaaggaagaactatattcctaagggaggaaatgaatttcaatcagaagcaagggtaacctcttcagacaacttagccgcggccgccaaacccttctcgaatttactagcaaggtcgcgaacggagagacgattatgctgttccaacagctgtgcagtctcacgagcaacaacatccttcattgatagcacttttgggtcatcctttgtctctattatctgattgttagctccaattctgtaattaggaaaccgactagaagcaaacagaacatcagaagaaaccgcaggcacagcctccctttgcattgtatcaccaaaatcacgagtcaacctcgtcatttttcacaaccaattacctctgccaatcacaaaaacacgccctttagcaaaggaaattcaacaaattatagcttagaataattaaaaaaaaaaaaaaggaacatacacatactcagatatatacatgaagaagagaacaaaaacaaaaagtacaaaacaaaacaaagcataataaaaatgagaaactaataaatagagataccataacaccacaacccaataggcctactgaagtcaaagcatgttttgaaagttttccacaaggaaacaaaaccccgcaattccttttttttttttttttgagttgaagcagtgaggaaaagggtaacaagaaaaagacaaaaagaagaaagatttaacttacaggtcatgagaaggtagaaaatcggtagctaggcttgtgattctaggatcagatgcaaaagggttttctccaatttggctatagtacacaagcagtggtcagatcaacggttttagagagagagagaacagagagaataagcatatacacagcatatggatagagagaaagatgaaagctttgctttttgaaaagaggaagcgaagggaaaaagaataggttgtgttgtgccgcccgtgggtgaactggccccccctttacgggattttagtgttaacgttttgtgttatgttgtgttgtctttgtgtgaacgttggccacaaccacaaaaacaacaacagctttgaatggaactaggcttacttggatccttgtcttaaagatgttacatacaactacaactatgttgttatgtttgttgctattacaactagtagtattgctactaccattaccattacctttcatcatgcttatgctttaaacttaaatctcgtccatttcagggtcccattccatggccttcctagctgttcaacgtttacttcacgctcacagcttccattttctttttttgcatcaaaaaaatttaacagtgccaaccctctctctttttcttctttttctaatgtttcgtctgcaattatattattcacgttcaatgcattggaggttgctttccgtgttagttatttgactgggatttgttggtggtggcagtggagtcaaggaaaacttctcacaattataaacttttttaagtaaataaataaacagtatatacatccattgtagactttatattgttattaaataataataaatatttccttaatatactaagaatgtattctaacctcagatactaatcctgattgtagtgtatgattattgctgatccaagaaaaatttaaatataaaataaattaaatataaattctctgattaaataaatcattttttacatataaatctagcaagtcttgtactgatacaataacattatgattttgtcttatttgttgatgttaattttgtcatgattattttagaagtaatgcttacataattcctttttagttgatagtataagaaaatttataataataatacatatttttttttaatataagtagaaagaatttgatatgctaataacagtttttatgtgcattggttggtagatgaaaagtttctacttttctaaaaaatcttaaaataaaaaattatgattctcatatttaatatacaattaataaaaaagattgtcagaaattataattaagaaatcaattttagctcactttttgcaaaaatattctcaaaaaaggagtaggaatccaaccttttcaaataaagagaaagttatacttacctattttatatgaatctttaattcataaaaaatatattaagattaatcaaacataaaaaatatattaagattaatcaaacatattctcaagattcataatttctcataatcagttttctaaggaatcatatattttgaatatgaaaagaaaaaaaaatcctacaaaactctccttagagtaagtctcaataattgttgaggtgaaaaaattattttatttaaccctcaaaacttttgagatttatataataacagaatccatgcaaaagcacaagtgaaacctgttgaacgggatttgtgttggtaattaagaataattttgagaaaagaaatcgcgtaatcggtaatagtgtgacggttggcactcactaatcactatcaaccagctgtaaaaaaatcactatcaacaaagaaattttataaaaaaaatgcatacgaaacgggaagtcaattcataagaaagtatgtacattattggaaagttaaaataaattactttgagaaaaatatttttctctgttatgttttcattgaatctatacaagaaatacatcaccaacaactgcaagaagaaaaaactaacttttacctatgcagcttacaaataagcataataaataactgttatccagtaaattttgaaatcattgctccaatgatgcaagagcatattccccttccacaatgtgtgcacatatgaattattatggcacacattggacagttgacatattgcaataaaaaataattctttcctaataaacctatttcagaatcaatcacaattaattgcttattaccattaggtctttatacattaaatggaattaccgcgctgctaattcttttagctacaataactgcgtttctaatttgctataatggctatattgttatatttttctcactcctgttgggcctctatacatttaattacttatgaagttgggtatctatattaataacaattttttcaatgaacaatagatagatgcatgtagtggctaattaagggtttatcatgactatattttcacattagtctagaggatgaaagatacaatttgggtaatatattaacttaattggatgcacttgcttttaaatcacattacactccaatgaactctactttacatgagacccagaggatctcacacattatgaccatacaatttgtatcacattcacaggttccaaaatattcatttgatgtaaccacaaactacttacgcattgcatgctgttaggcaaaatatgatattctttctttattgtgtcttactctaactaaaacctaaccaaataagcaatttttcacatttttattttgttggggggaaattcattattgacttggtgttagaatgtctttagagattccatcccctactgcatctcaattatttgcgttgggccttcacctcaagttaagcacaacgaattacttttcaaccttaatttatttttattaatctaataaaatctttaagtttttgctaaagttattgatacatgcggggaacttataagcccttctttttctatgctatgtaaatatcttgatagtgatttattatttgaatttagattttttctaatttttacgacatcttaaattaaaaaattacaaaatttaaataaaaaaattcctaaaagagcaaaaatctccgttgagtaggacatgtacacatgggaagggccaaggggctgctagttccttatctcaatcatgttcttgtctttttattctcaattttcatttgaaaaaacaaatacaaatgcaatcattgtcattgttttgattcattcatcaatgcaatatccatcacaattcacaaggcaaggtgtgatagttgattaggaactccttaacttttaaggttgtcttttttcagtaggagagaagcggaaaaagttataacagcaatgaaaaataaaagaaatccacactgtcattagttcggttgaactgaaagttacaatatataaaatatcttcagaaacaatgggattcacgagtgtaattttcttcacaaaactacaaaactgagataaaagataaataaaaaatacaataaaaatgtgaatttgagtgttttaaaatttaaacttgttagctcataggatacgcacacgtgcagacaataatttttttatatttgattatgctgcattttacatttgattattatggttagcaaaattgattatgatggagacatattcgaatataaaaaatgttatttgatacgaatagtttttttgtgcaatttacacaaaccttgttttgagcacttgttttttcattaacattttttttaatgttttaattatatttattttaaaaaaaatggtattaaagtacaagaagtcatgaaccgttcgtgcgtttcgtgtttacgctattcatactgaatagcagtactcttcgaatatttgttttttataatgcatgctcagtgagaaattgaatatatctttgtttggctagcaaaattgaatatgcgacttgctttttataactcatgcacaaccacaagttaaaagagatattacacaatcattatataaatgtttttaactatatttttttcattttattacctattaaatcatttaaatttaaaattttcacctcatttcatctcgatctgaacaatttcactttcatctctctttcattttttacactttgattcctaattttcttttctacctaagtgtgggattgcatacacgtataagtatcgattttccacttttccaaaaaaccaaacatgactagaaatggtatcgattttccacttttccacttcgaatatttgaaggatttacgttaaagttaaacagagatatacaaacaaatccaacttcatatggaggtaggttatatacacaacataaccccgccaatgatttagaaatggtaattatatatataggatactaagttaattacagacggtggacccaagcatccaattgtgaaaaggaatgctctcaaaggagggagagggatatctaacaaaaaaagaagaaggaataaattctttttttatatttctattttgaaagttataagaaaaataatagaagtttattttaagtagtagattaaccaaagattcattttacataaatttagtattttaacctttaaaatgtactgaataaatataaatatttatttttatataatttaaatttaaaaaaaatagataatgcatgtaaataaattagagttatcaaatcacacctcattatatataataaatttattaacttttataatatctcttaaaaattatattaatgatattttttattgatacatgatcattaaatttttaaaatttatattaaataaatatttttaaatacataaaattatattataattaatatttatgataaataaatatttttaacatatacactacattttgaatttatgatcaataatttatattatgatacaagattttttaattattaaaactttgtttaaatatatattgaaattcaattttgaaaagaggacgagaaggctagattaaaagagataatcagttaaacaaaattaatttaaaaaaattactgtttattgttaataataaaaaatacattttattctctttaaataatactatttgtttactttgtgagttatttttcactatcattattattagatttagatccaaaccctaatcatagttcagaaataaacatctaactggaattttcacttttcagcagagaagcctctccgattccggcacggtggtcggcatagcatttttcggcggctcatctccgcaccgacgtgagttgacgtaggaatcgtaaaaccaacgggaaagccttatccggcacgtgagttcgttatctctttcccttctctgctgtgaaagtgttgagagttttatgagtgctgcatgtttcgatttatatttgtattttgtgaatatctttatcaatgcaatctataagtttgtttttgttcgtgattctagctgtctaaatgcttcttgttctgttctggtattggctttactatatacacatatattctgtctcctaatggataatacattagagctttttatagtcattgatttttcaccttcaagcttagaaacttctttgcaattatttaaatttgatttgatgtaattagccaaattatgccgttcctttcatgatttgatcacaccttagtagtatgcagttgttttatgtttgtaaaataggttaatatgatgtaggtacagataggtggcctatttaggttggagaaattattaggttgtcccggacaaccacctatcttatctatggttcttaccaatttttaggcgacatgcatccaagtttttcaatttaagagaaagaattaacaacactcgattatatgtcatttagagattagttgaaaccatgataatctagtaatacctaatcatttatcatgatggtggtcatgtagagattacaatggcattgttatctggcattcttatgatgaaaggcctattggcgtacttatgcttatttggcctacttaagctgataagttaactgaccttagacagtcttttagacctggccagacttttaaacaagttaagccaaacctaaaaagaggctatgcaggtaaacaggtcaagctttgtaaataggaacgccaagtttaacttgatctgaattgtttctatccttccttggaatgctttttctcattttgccctcttttcccttttatttttgtaaatttgtgttttcctatgttactcactttcttcaattcaccatttcacaactattgcatattatttctctttctcttcctacaaaacccccatatcaaagattggaactttcaacaccattgaaatttatgaacataaaatacaattatccatttgtttcaaatcatcaataattgctttttttgggtgccgtgacagatatggcagataaagatgaagaggctatgccaagggacgcaaatattgtgaagtctttgatgaaatcaatgggcgtggaggactatgaacctcgtgttatacacaagtttcttgagttatggtatcgttatattgttgacgtgttaacggatgctcaagtgtattcagagcatgcaggcaagtctgaaatcgactgtgatgatgttaagcttgctattcaatccaagcttaacttcagtttnnnnnnnnnnagcaacagcagaaagatccgagttacagaatttcttgtaaactgccctaagcttacttcctggtgcagcagcatgaaggttgcccatgattttggcacaatccctggcagcaaaaataaacaagagtcacttcatgaatgtttaaaaaacacattaactacttgcattttgaaaataccaatttgctggtccaagaaaatattaaccttagttgctcctcagagtagcctgtgtagtgcatcaaagtgtttgtccagaaagggctccttccaagggtacatcgagccgcaaacacagcagaagcagcaattaaagaagggcggtacaagattacagttggataatgcatcaatccaagttcagcaagaaaaaacaccatgttctccatctacattgacgaaaattaggcatattcatcaggctattccactctggaatcttttaaaaaaaacaaaaacttaacaaccaactaccaaaatatacctctttgtcagatggagtggaggctttggtatacctaaccaagaagtgatagggtgttggaactgttaagtaccattcaagtttcctaaggattgttttctccatcatcaacacttgttcactaacataagcattgtctgatatgcacacaaagtcattaacctgcaaacatacattggaaatccaccccataactcataagtaagcactttctcaaaacatgatccataaatcatcatagaagagaaggaattccacctctggtgcccatatctcttcatattttgaggctatcagcattgagctgatgccaaccagctgaagctcccttctaggcacagccttcacannnnnnnnnnnnnnnnnnnnnnnnnnnnnnnnnnnnnnnnnnnttgtctctattatctgattgttagctccaattctgtaattaggaaaccgactagaagcaaacagaacatcagaagaaaccgcaggcacagcctccctttgcattgtatcaccaaaatcacgagtcaacctcgtcatttttcacaaccaattacctctgccaatcacaaaaacacgccctttagcaaaggaaattcaacaaattatagcttagaataattaaaaaaaaaaaaaaggaacatacacatactcagatatatacatgaagaagagaacaaaaacaaaaagtacaaaacaaaacaaagcataataaaaatgagaaactaataaatagagataccataacaccacaacccaataggcctactgaagtcaaagcatgttttgaaagttttccacaaggaaacaaaaccccgcaattccttttttttttttttttgagttgaagcagtgaggaaaagggtaacaagaaaaagacaaaaagaagaaagatttaacttacaggtcatgagaaggtagaaaatcggtagctaggcttgtgattctaggatcagatgcaaaagggttttctccaatttggctatagtacacaagcagtggtcagatcaacggttttagagagagagagaacagagagaataagcatatacacagcatatggatagagagaaagatgaaagctttgctttttgaaaagaggaagcgaagggaaaaagaataggttgtgttgtgccgcccgtgggtgaactggccccccctttacgggattttagtgttaacgttttgtgttatgttgtgttgtctttgtgtgaacgttggccacaaccacaaaaacaacaacagctttgaatggaactaggcttacttggatccttgtcttaaagatgttacatacaactacaactatgttgttatgtttgttgctattacaactagtagtattgctactaccattaccattacctttcatcatgcttatgctttaaacttaaatctcgtccatttcagggtcccattccatggccttcctagctgttcaacgtttacttcacgctcacagcttccattttctttttttgcatcaaaaaaatttaacagtgccaaccctctctctttttcttctttttctaatgtttcgtctgcaattatattattcacgttcaatgcattggaggttgctttccgtgttagttatttgactgggatttgttggtggtggcagtggagtcaaggaaaacttctcacaattataaacttttttaagtaaataaataaacagtatatacatccattgtagactttatattgttattaaataataataaatatttccttaatatactaagaatgtattctaacctcagatactaatcctgattgtagtgtatgattattgctgatccaagaaaaatttaaatataaaataaattaaatataaattctctgattaaataaatcattttttacatataaatctagcaagtcttgtactgatacaataacattatgattttgtcttatttgttgatgttaattttgtcatgattattttagaagtaatgcttacataattcctttttagttgatagtataagaaaatttataataataatacatatttttttttaatataagtagaaagaatttgatatgctaataacagtttttatgtgcattggttggtagatgaaaagtttctacttttctaaaaaatcttaaaataaaaaattatgattctcatatttaatatacaattaataaaaaagattgtcagaaattataattaagaaatcaattttagctcactttttgcaaaaatattctcaaaaaaggagtaggaatccaaccttttcaaataaagagaaagttatacttacctattttatatgaatctttaattcataaaaaatatattaagattaatcaaacataaaaaatatattaagattaatcaaacatattctcaagattcataatttctcataatcagttttctaaggaatcatatattttgaatatgaaaagaaaaaaaaatcctacaaaactctccttagagtaagtctcaataattgttgaggtgaaaaaattattttatttaaccctcaaaacttttgagatttatataataacagaatccatgcaaaagcacaagtgaaacctgttgaacgggatttgtgttggtaattaagaataattttgagaaaagaaatcgcgtaatcggtaatagtgtgacggttggcactcactaatcactatcaaccagctgtaaaaaaatcactatcaacaaagaaattttataaaaaaaatgcatacgaaacgggaagtcaattcataagaaagtatgtacattattggaaagttaaaataaattactttgagaaaaatatttttctctgttatgttttcattgaatctatacaagaaatacatcaccaacaactgcaagaagaaaaaactaacttttacctatgcagcttacaaataagcataataaataactgttatccagtaaattttgaaatcattgctccaatgatgcaagagcatattccccttccacaatgtgtgcacatatgaattattatggcacacattggacagttgacatattgcaataaaaaataattctttcctaataaacctatttcagaatcaatcacaattaattgcttattaccattaggtctttatacattaaatggaattaccgcgctgctaattcttttagctacaataactgcgtttctaatttgctataatggctatattgttatatttttctcactcctgttgggcctctatacatttaattacttatgaagttgggtatctatattaataacaattttttcaatgaacaatagatagatgcatgtagtggctaattaagggtttatcatgactatattttcacattagtctagaggatgaaagatacaatttgggtaatatattaacttaattggatgcacttgcttttaaatcacattacactccaatgaactctactttacatgagacccagaggatctcacacattatgaccatacaatttgtatcacattcacaggttccaaaatattcatttgatgtaaccacaaactacttacgcattgcatgctgttaggcaaaatatgatattctttctttattgtgtcttactctaactaaaacctaaccaaataagcaatttttcacatttttattttgttggggggaaattcattattgacttggtgttagaatgtctttagagattccatcccctactgcatctcaattatttgcgttgggccttcacctcaagttaagcacaacgaattacttttcaaccttaatttatttttattaatctaataaaatctttaagtttttgctaaagttattgatacatgcggggaacttataagcccttctttttctatgctatgtaaatatcttgatagtgatttattatttgaatttagattttttctaatttttacgacatcttaaattaaaaaattacaaaatttaaataaaaaaattcctaaaagagcaaaaatctccgttgagtaggacatgtacacatgggaagggccaaggggctgctagttccttatctcaatcatgttcttgtctttttattctcaattttcatttgaaaaaacaaatacaaatgcaatcattgtcattgttttgattcattcatcaatgcaatatccatcacaattcacaaggcaaggtgtgatagttgattaggaactccttaacttttaaggttgtcttttttcagtaggagagaagcggaaaaagttataacagcaatgaaaaataaaagaaatccacactgtcattagttcggttgaactgaaagttacaatatataaaatatcttcagaaacaatgggattcacgagtgtaattttcttcacaaaactacaaaactgagataaaagataaataaaaaatacaataaaaatgtgaatttgagtgttttaaaatttaaacttgttagctcataggatacgcacacgtgcagacaataatttttttatatttgattatgctgcattttacatttgattattatggttagcaaaattgattatgatggagacatattcgaatataaaaaatgttatttgatacgaatagtttttttgtgcaatttacacaaaccttgttttgagcacttgttttttcattaacattttttttaatgttttaattatatttattttaaaaaaaatggtattaaagtacaagaagtcatgaaccgttcgtgcgtttcgtgtttacgctattcatactgaatagcagtactcttcgaatatttgttttttataatgcatgctcagtgagaaattgaatatatctttgtttggctagcaaaattgaatatgcgacttgctttttataactcatgcacaaccacaagttaaaagagatattacacaatcattatataaatgtttttaactatatttttttcattttattacctattaaatcatttaaatttaaaattttcacctcatttcatctcgatctgaacaatttcactttcatctctctttcattttttacactttgattcctaattttcttttctacctaagtgtgggattgcatacacgtataagtatcgattttccacttttccaaaaaaccaaacatgactagaaatggtatcgattttccacttttccacttcgaatatttgaaggatttacgttaaagttaaacagagatatacaaacaaatccaacttcatatggaggtaggttatatacacaacataaccccgccaatgatttagaaatggtaattatatatataggatactaagttaattacagacggtggacccaagcatccaattgtgaaaaggaatgctctcaaaggagggagagggatatctaacaaaaaaagaagaaggaataaattctttttttatatttctattttgaaagttataagaaaaataatagaagtttattttaagtagtagattaaccaaagattcattttacataaatttagtattttaacctttaaaatgtactgaataaatataaatatttatttttatataatttaaatttaaaaaaaatagataatgcatgtaaataaattagagttatcaaatcacacctcattatatataataaatttattaacttttataatatctcttaaaaattatattaatgatattttttattgatacatgatcattaaatttttaaaatttatattaaataaatatttttaaatacataaaattatattataattaatatttatgataaataaatatttttaacatatacactacattttgaatttatgatcaataatttatattatgatacaagattttttaattattaaaactttgtttaaatatatattgaaattcaattttgaaaagaggacgagaaggctagattaaaagagataatcagttaaacaaaattaatttaaaaaaattactgtttattgttaataataaaaaatacattttattctctttaaataatactatttgtttactttgtgagttatttttcactatcattattattagatttagatccaaaccctaatcatagttcagaaataaacatctaactggaattttcacttttcagcagagaagcctctccgattccggcacggtggtcggcatagcatttttcggcggctcatctccgcaccgacgtgagttgacgtaggaatcgtaaaaccaacgggaaagccttatccggcacgtgagttcgttatctctttcccttctctgctgtgaaagtgttgagagttttatgagtgctgcatgtttcgatttatatttgtattttgtgaatatctttatcaatgcaatctataagtttgtttttgttcgtgattctagctgtctaaatgcttcttgttctgttctggtattggctttactatatacacatatattctgtctcctaatggataatacattagagctttttatagtcattgatttttcaccttcaagcttagaaacttctttgcaattatttaaatttgatttgatgtaattagccaaattatgccgttcctttcatgatttgatcacaccttagtagtatgcagttgttttatgtttgtaaaataggttaatatgatgtaggtacagataggtggcctatttaggttggagaaattattaggttgtcccggacaaccacctatcttatctatggttcttaccaatttttaggcgacatgcatccaagtttttcaatttaagagaaagaattaacaacactcgattatatgtcatttagagattagttgaaaccatgataatctagtaatacctaatcatttatcatgatggtggtcatgtagagattacaatggcattgttatctggcattcttatgatgaaaggcctattggcgtacttatgcttatttggcctacttaagctgataagttaactgaccttagacagtcttttagacctggccagacttttaaacaagttaagccaaacctaaaaagaggctatgcaggtaaacaggtcaagctttgtaaataggaacgccaagtttaacttgatctgaattgtttctatccttccttggaatgctttttctcattttgccctcttttcccttttatttttgtaaatttgtgttttcctatgttactcactttcttcaattcaccatttcacaactattgcatattatttctctttctcttcctacaaaacccccatatcaaagattggaactttcaacaccattgaaatttatgaacataaaatacaattatccatttgtttcaaatcatcaataattgctttttttgggtgccgtgacagatatggcagataaagatgaagaggctatgccaagggacgcaaatattgtgaagtctttgatgaaatcaatgggcgtggaggactatgaacctcgtgttatacacaagtttcttgagttatggtatcgttatattgttgacgtgttaacggatgctcaagtgtattcagagcatgcaggcaagtctgaaatcgactgtgatgatgttaagcttgctattcaatccaagcttaacttcagtttcnnnnnnnnnnagcaacagcagaaagatccgagttacagaatttcttgtaaactgccctaagcttacttcctggtgcagcagcatgaaggttgcccatgattttggcacaatccctggcagcaaaaataaacaagagtcacttcatgaatgtttaaaaaacacattaactacttgcattttgaaaataccaatttgctggtccaagaaaatattaaccttagttgctcctcagagtagcctgtgtagtgcatcaaagtgtttgtccagaaagggctccttccaagggtacatcgagccgcaaacacagcagaagcagcaattaaagaagggcggtacaagattacagttggataatgcatcaatccaagttcagcaagaaaaaacaccatgttctccatctacattgacgaaaattaggcatattcatcaggctattccactctggaatcttttaaaaaaaacaaaaacttaacaaccaactaccaaaatatacctctttgtcagatggagtggaggctttggtatacctaaccaagaagtgatagggtgttggaactgttaagtaccattcaagtttcctaaggattgttttctccatcatcaacacttgttcactaacataagcattgtctgatatgcacacaaagtcattaacctgcaaacatacattggaaatccaccccataactcataagtaagcactttctcaaaacatgatccataaatcatcatagaagagaaggaattccacctctggtgcccatatctcttcatattttgaggctatcagcattgagctgatgccaaccagctgaagctcccttctaggcacagccttcacagacaggaaccgatcgacaatgttcaaggtcaaatacagagtttctggcatgagctcaaacttcctatgcacttctaccaaccagtccacaaggattgacctcatcttggcattaatatctggctgcgaacccatgtagtcatgcacacaaccatctttctgtttcatcaaaatcaaatacatgtatgtataatataagaagtgcataggaaaaggggattatagggattaaacaaagaaaaaagcatagagcattacttcagtctctttgtaaaatttgtagatatcatcgatgtactccgctgctgccaattcattgtccatgtcagttgcatcaatgttcaccacaaaatcccttggaagtccacaagcagcctgaggttaacaagctgttagaccatgtaccagaaaaagggcaacccacaaagtcccaaaccacattcagaaaaatgaagaaaaaaaggatcaaccttgcttctagcagagaggacataactgaaggccttggcattcttcatggaagatttttccctcgccttttttcccttcacagcttgcttttcttctgattcatcatcagagctaatcacaatcacttcaggttcttctttaggcttctttgctgcttccacttttctagcaggaacaaaattcccaacaccaaccccatcagttgctaccactgctcccttgttcacttcagtgcttaatttctggataacaaccattcacacagatttagagacacatccgttaccaaaaagagaacaaatttcttcactggtttctttgaaaatcagataggtaaaaactaaaaagtcctaaaaaaatcaggggaaagagaataacaaccttgttcttttctgttgcggcttgtgcattagccaatagttgagcacgaaagttcctagtaaaaaagaaaagagcagaattaggcaaaagaaaacagaagaaaaattatgagagcttaaaaaaacaaaacatttcaaaagaaaaaagaaaaaagaaaaaaccttgtgacaggtttagacacgttaattccatttccatggccttgtttacccacgagattcccaatatcctgcagcacccttctgtttcttccttcaccacccttgtttttctgcttattctcatcaccaactaaaccacacaaaaaaaattcacaaaagggggaatttcagaaacgaaaaaataaaaaaccaaactttatccaaacaaatcttgaaacctaaaacattcaaacatttatcaacaccggcagcaagaaaacaacaaaaagaagaacaaaaaccattgatgggttgttgctgttgttccaatctggaagccatgataacactttgatgcggttcttgaaacgttgacccgaaaacaccgccaagagtcgagaacagcgacgacagaaaaccctgaagacctccgttccgcgcctctcctccgccgctcacgtcggttgtcgccaccgcggaatcaagcactgtgttagtttgttgttggtagcaacctttttccctctctctcttttgcttctacgccgaatgtacgaaacgaaagtatgaaacagtgtgttgcttcttggtttctttgttcctttgagaaatgaaacgtttgggtctacggctatgtttttttatacgacaacaccctcacctccaacggtcgattctatattcaatcttgaccgttggattctctttggcatcaaaggctactattcgtttattcactttccttgcgtttttttatagccgttactctcacttctcattccctgagtttaaccgctcctcctgcttttgctaccattgcatcttcttgttcttatccctttttttagtactaacaaataaaaataggttctggggttaatagtaaaattagtccctaaagtgtgaaagtgtgatgataaattgatcatggaaaatacaaatctagtttatgtgaaaaaaatatgataaattagcatcattatattattaaattataatgtttaagaataacaataagttatatttttataatcaattaaacattaaattataaaatttaaaaattaatttgtcattaaatttgtcataatttttgtacattcaaaaattaaattttaattcttcatctttatcagatcaatttgtcattaaactctttcaatttctcttcacttttgcactttatataataattaattattagtatattaatataattatcgacttagcattatacaaatgtcctttgatttatttttaagttaaactaaatttatcattaaatttttacattaaattttctaaattgtttttaaaacaagtaagtattgaatatttctaattacatttattaatttgaattctttaaataatatgtttaaagctttcattaacacttgcttattttaaaatagattttagcatgaaataatactagctagtatgtttattaatgaaggggttgacaagattttcaaaacctatgctttgaaaattaacggctagttggatcgaaaacacctgtaaatcagaccaatttagttgaaatagatcacataatcagtcctgagaataataagttaaaaaaatttaaaatcagtcaataatcaataaaatattacaaaattagttttaattagtaaaaaatggtttaaacaacattattttattttattttatttttcttaaaaatatgaaaatcaatttaaggtgtttgttatgttttgcttatggacattgttgtgtattaccaaaatgtagatttaaatattatgttatattttatataatttgattaaatttttcatttagtttctataagttacaaaaactttccatctcctttacttcatatactcaaaagcatttcctttagctcctataaacatatttaatctcctttaatcctggttgtaggggctaaaagaaaataaaatgatatatgtaagattgaatagattaaatggtatatgtaaaaactaaaatatgatgtttttaagtatagggatggaaaaatagagtgtttttctttttgtaaatttaagaaccaaaatgggtaataaaatcataaaaaaatgttaggaatacattatttgacattctttaaaacatgctttaatttgtcttaaaacttacaaaaataaaatatgaattctacatctcatttaatgattcttttatgattttgtagtttttgataaattttagttaataaaaaactaaaaaaagtgttaaaaaatattttactatcacttctcttaccatggaaacttgttagttgttacaagatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaactcatggttttgtttaattgtactttttatttttcttaattttttaatttggtgaattccatctctctatttttgttgtttaccttgttattttaatcgtacaaatttaattcagtcattaacaacatctaattttaaagaaaaattctaacgtgacatatgtgatgaagtgtcacgtcaacataaatatacaaatgtgacagtccattggagagtcatataaatattttcgttaaatattaaatgtgaagttaacaaatcagttaaaacagcagaattgaaaaccgtgaaaatttttttttaaagaaaatattaataataagacaaaatttgtgaaactaagaaagtaaggagataaaaaaaatgtaattaaaaacaatttattcttctgacttatttttataaaaacccttttacaatagaagccctcccaaaacaaattccgaacaaatttacgttaaacatatctacaaagtgactaaacattcaaattgaatatatgttttctaaaagtactctttatttggtttgagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattttaaaaaagtaagtattaaatattttttatatatttaatactttctgataaaaaattttactttaatgtctttaaataatatttttacagaattcattaattaatatttactaattttaaggaaaatataaacataaaataattaatatttaccattattaatataaaggagatgtatctaatcagaaaaaaattattataaaatgacaagaataaatttgaattataaaactataagtgaatgattttacatatttttcagtttatattaagagtatttcttcaacagaaagagatcaattcttcttaaattaaagatatgaatattgaaataagaatgggtatgatctcttcgttttttaattttcataatattagtacgtagtacatactagtacaattgaattttaactaattgacctgttcaagaaacctaactcctagaaaaaaattattaaaaaatgacaagaataaatttgaattataaaactataagtgaatgattttacatatttttcagagtttatattaagagtatttcttcaacagaaagagatcaatccttcttaaattaaagatatgaatattaaaataaatatgtgtatgatctcttcaaatgaagtcttttaattttcgtaatattaattagtacgtagtacgtactagtacaatcgaatcttaactaattaacatgttcaagaaacctaactcctattaatcaattaaatacgtccgtttttattggttaattaaatgggtttttatatctgtccctaattaaaaccggtcaattatatctccatgaaagacactagctaacaagccacattcttcaagggttgaggccgggaacacacattttggcatcaaatttgacaaacatagggcaaatgtgaccttgaacgaaaaaaggaattttgtaatgtttctaaacaaagaattaaccggatttgatcatccaaagattgaaaacaattatataaattatatgcagctgaaccttcaactttgtgtacatggtggaactgattttgttcattattttaattgggggcaaatattttctcaaacatcaaattattgtggtcattacaactgctaaaaagttttcccaagaaggaaattaaccacctatatatatctatatatatatatatatatatatatgccgaaaagcagaaagccggaaactataaaacaaaatggggatatcccaggcacccaacaagttcatatttgatcaaatcaaaaatcggaaatgacaaatttaattactgatcaaagattcaaaattaattactaattaactattgtcataattaagtggctagaagttatttgcattaagaaattaaaaagtcatactttacgaaagctatttatcctgtattgataattaaaccttttaaaaaattaataagtaattaattttgagaggaaatcgtcactttttttattattaaaaaggctaataatgcatgtgtagctttgtgaggaaaggacgtcgcttaggtgcatgcatgtgataattagctggataagtgcttttctaagacagtcatgtgacgattgacgttgaagtcacgatgcgcctatgtacgtgtcatgatttttaccattctcattcgattaaactctatttagccaattgtttagtagacaaaatttaggacactttgtatatcccaaaaaaataattattttctttgtagttgttttttactggagatggaatatcgaattaaatagagaatataacattggcaatgtttataataaagtatctattttttatcttaattatttattatattataaaaccaatattttatgtataattttcttttttgtgtgactatgatattagtgtgaaataattattaattttattgataataattaatttttattagagaaaatctgattagttatttttaatggaatatcttctctgatttttttttccttaacaatattcaaccttaatttcttgcttaagaaatctaatgccactcagacaaacaatacggtacaatcagtccctttagagcaaacacctatatattttacgtgctatattcaagtttgcacgttaatcaaaacacacaagataaatggtctgtttgagtaagtttctctagaagcacttttaaaaagaaaataagagcaaaaagatgaaatgagtttttccataagtaaaaataaactctccattagctaatttatagaagctcacaaatataacttctctaaaagatgagatgacatctacaaattagctaatagaatacttattttagtttatggaaaagttcatttcatttttttcttcttatttttctcttctagaagtgcttttagagaagctaacatctaaacaggcccaaacattgatacgttaagaaatttagtttccataatgtgtacatacattatagaaattatagtttacatatcatattagtaaaatgaaattatagatttatgtatgaaactacattaattatgaacactattttttgtaaaatctgcggggtgggggaaccctcaccagacagtgaagaagggaaaggaaatgctcggagcaagaaaagataaggtggaagggaaagtaaaatggcttaaatgaggtggacgtgagagtatttttggtgttagaaaactattagtgagggtccttttggtgttagaaaaatacaataaaaggaaggggtgtgaaaagaattaaaaaaagttgtcaaaagaaatggtatttttcttcttatcattaatgaattcgaattttagcctttttttatattattttccaaaagaaagggctagaatccacacattaatgagaagaaaaagtccatgaagaatgaagcggtggagattaaatgtacaacaacaccacacatatttgcctttaactatcattaaaaaaaaaaaaaaaaaaaaaaaaaaaaaaaaaaaaaaaaaaagactctagtccaaagtctttaactatcataattaagaaaaaaactactctagtccatagttcgctgacttcactcacttctaagttattttccatttaattaaactactataactgcaaataatgctcttacctcatagaaaggtcatttttatcttagtaaaaatgatatattgttattagccactattatctatatatgacatgagcaaggttatgtagttttgatattttcaatcttgatttatcacgattatggatttttactctttcggtcaacctctttttttagattctcaagctgccatggataccaactttaaaactttgaaatgtgttaaatcactacattcagttaactaaatgttgttttagaaatttagactttgaaatagtaatatctcatttcttttctttattttttcatcaccaattcctttatcctaagaaactattttttattgatagcgaatttgcgtttgttctgttcactttttctaaaagaaagccagaaattgagctacttttttcttgttctttttgtcacctgctttctcagtattagattgaaaaataaaactaagattaaacatacaatttagtcatgtatgtgtacaaacctattaattaaatcagtcactatatgtgcaaccgtaaccgatttatttcctaccatcatacgttaattttgaactcttttatgcattcttgtctttatacgtatagttcattcttaatttaatctttatacatgtattttattaacttagtccatatatgtgtagtttattcttaatttagttccatgtgtaagtaaattgtattatgataccaactaatctttgcatagctcgtaatagatgtgagttttattaattcttttttctaaattaaaaaattcaattatatatcacatagaaattggttgagattgaaacataaatataggccggcaacacttgtgatggtttccaaagatccaataagaccacttaggtctaagttgccacaatattgttctatggaagccacggactgttagaagtttggcccgatttttttttggtgtgatagtttaagattatctaattaataaactatcaattcgattcgttaagcgtcaccctctctcctaaataactctttaactaatgaaactatataagttattcctaaaatattaaagatcatgctacatagtcctcaagtattaaaaaactcttcaaaacattgcctaatgttagtaaagtatatcaactcccagtaaaaactaaattgatagatatttaatactttatttagcttctagttaattatataattttattattttaaatattatttaatattttattagtttgaagaccaacaaattaaagcacacctagctaaaacgtaattaattaatttaacatgttttgtatgtagcagcaaatgcatccgcctcgtgtcacttccttgtgccaccaccgcccggacccttcttcctcctcttcttttttatataagaaaccaccaaagctagttccaaacatatcactagctagctactcctcatagaattaaaacaatcatatatatgtattcatatacctacctccatatattcagagttaaaacatcccttctcttgtgaggattaaccatacaaaatgtccaagtttagtaacgataattattttttcatcattaataacattaattattttaataaacatgcatatatatatatatatggaaacatttgtatatataagaatgagataatcaaatttgaacagtataattatacataaattattaagattaaattttaaaaaatcatatattttaaaaaaactcacatgttttttttaaaatagttacataataataagttttaacagtttatatttgattatactggtcaaatttaatttttttatctataaaatacatattcttctcaaataatatgtcttttcttatatatatatatatatatatatatatatatatatatatatatatataatatagaaagtgnnnnnnnnnntttttatatatatatatatatatatatatatatatatatatatatatatataatatagaaagtgtcgtctcatggttaatttaaaaatttcttgtagattcgtttggtactgaaacagttgagaaatggggcttagcgagtctctgaagctacatgatgaaaactcgaaggtggcagcgggtgtgagtgcggcgatgtgtttgatcttaggtgggatctttgtgtttatagtgtcttatgtctgcattcgtcttcgctcccaaacccatagggacgtgcctgccgctgtcgccgtcgtcagcggccaagaaacggtcgacaagtgtcccgtcttcgtttactcgacggtggagaaggagaatgtggcggcggaggagtgcgccgtgtgcttaggcgagtttgaagactgtgatgtggtaaagatgctaccaaaatgtgaacatattttccaccagcattgtattgatgcgtggttaccctcacacatgaactgtcccatttgtcgcgagaaggttgcgtttgataataatgtctcaatggaagaagaagaagaagaagaagaagtactaggtacagagtccgaggtggtagggacaacagcggaacctgaaactgttgtgggacccgaggaggaggaggaggaggaggacgttggacaagtgcactctgagtctgagtttgttgcttgaatcgtgggaggattttttaattccctgtgttggtgcattttaccaacattaattatgttttctgactaaattaaaactccggttcatttttctagttatgtttcgtttgtttatgaactttgtggattcaaagaaggtgcatgtgttaacatatatatgagattttattaaagatgatgaaatcaacaattttttttacaaagattaatggttaccacttaacaaaattattagaaacttcgtatctataacattgaaaaaaagaaagaaaaaggatgtgtttattatctattaaaaaaagtgaccttgctataaaataatttaatattttgttttaaaaataaaaaatataaattaatttatgcttatttacaatcataaaaatcacttttttaagaaaaattaatttatgataagttatggaaaatagcttttgatttaaatcaggttttaaattatgttgaccagtcatgtttttttttaaatgattatatttttaaaatctttcctggaaaataatgtttacatgttgtacatgtttaagagtgtaatgtagttatgtagagagtaaatgaccttaaagaaaatatatttgcctactagtcgtagtgtagagataatatatagatgttgtccttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaataagtttatttctaaaatgtattttgttgaaacttgttattgtgaataaaaataaattattgaaaatatatagaattataattaaataaaaatattttgagaatgataaaattaaatatgttaaaattagttaaatttacttatattttaagtttaacatacaagaacatttgttttgcttatatacgagtttagaagaaatattttttagaaatagtttaactttttttttcttttttaaaagctaaaaatagatcaacttaatcaactaaacttcaaaagctaatttaagaagagaggattttacggttcaagttgtaaaagaattactttgatcatatttccaattaatatgcaagatatgttaacaaagattaaagaaataaagacatatttttatctccttaacttcaatccttaaagttggagttgacaaattcaaaagttaataggtcttgttatattggttaaaaactatattaattaaacacaccatacatattagtatatgctgtatttttttttttttggatcggttgcgtatttgtctaaaacaatttatttttttatatccaaattatagctgaaaaacataatatcacattagggtttggacatcattttcaggaccaactaacctctctacttgctaaatataatgcaaagtcaaacccaagtagttgcattgttttattgctatattgaaataattgtatgtgtagaattccaacactgcactaaataacgaaggtacaaccaatgctgtgttgttaaaggggtgacattttatatcaaaggatatgaattcatgtcattttcaatgtaacaaatacatctatttttcccaggtattttgattgataaaatatatatgacgaatagtgacaaaacttgagtttggtgcttcttgacaagtaaggaaaacttcaataatgttcagttactattactctaaagacaaattaaggcaagttaaaaatactgaattgacttacggaccggctcaattctttctaactaaaagtaagtcatcatgaagagaataaattttgaataagaataattaagtcatttacaaaacaatcgaatattatatgttagtttgtttggtatgttttataaattttttaacaaattaaacggatcatcctttagaagtacagtagataaaatgctctagttttgtcaatatttcctcctattattttaaaagaacaatcaaaatagaaatgtcctacgaagataagatatgaacgattaggagttttccctttatttattccttgatattctaaaagcatcacttattatatccaaagtttataataatgaatgagacatctaaccaagatatgtcaccgacccaccgttttggctcattccacgtgtcaactatcacatggctatttttgttgggatccagttgaacagaaaaactaaattaaatgtattgaaaaatatgtaaagaaaacaactatacttctatgacacaaattattgagagcaagatagagcagtgagtattttagtaattcagcagaaagtcagggcttcataaccactctggcagcacaagaatcccacattcttattctcttaagcttgctattaaaaaccagtttcactgtgcttcatacattttcacaaaccccaggaagaatggaacaggatagaagaagaagctcttttggtcctatgttctcaattgttccttgtcttctcttcctttttttctgtctctcaggatctgctgaggcctacaagaattacacagttggtgactctttaggatggtttgacaatactgaaaagtccaatgtcaattaccagaagtgggctgacagtaaagaattcagcttaggagatttcctcagtaagtttcttcatcatcatgtttttctgcttacaatccttgtgtgttttgttgtcttcgaaagagattgaggaattttattgttgttaatgttttggccttttgtcagtgtttttagacaatttcttatggcatggttgttcttgtttcatttccttgatctgatctccaatttgcatttatctggttttatttgactgaaactcgacactactatgatgtctaatcagatttagaaaaaatactggattggaaagaccgatcatattacatcactcatcccataacttttcaatgtttttattttgttaacttttttttatctttgcttttaaagcaatcaaagtatctattttctcttcacaatttctctacccgtcactttatgatggaggagaagcaaaactatatcatttacttatatttttattttggaatttgttttagcataacatacttctgagtgtcacaaaaaataggttggcttcaatcatagtactattgtgttgtttccctctgcagcatatatgctgtttttcgggtacgttgtgccatattcttaatatattaatgttagtcgatttagaaaaattggaaatactaagagaaaggcatcactactcttgttggtatttttatggagtctgccacacgatccacaaccgttagtctcaactaaagtattcacccttccatttgacgcaacacaatagctaacaaagaatattactgttagttaccatttgtccctttttgggtagaagggaaaaaagaaaaatccgatacccaaaatgacttgtgacaactactagtagtactttttattattcttttcttttggtacaaatattctgttttgatactctgattgagtggccactcaattctactagtttaatttttcttttatgtaaaacttgtaataataatattctgagacgaaggaaaaagtgaggaaagggacttgctttaaagctattagtcaaattgaagctaaccgtaaaccattacacttataattggcgatgattaagctatcatttaataaagtcatacgttttatgaagcataaattagaaaaagaaacattgacttgaaccaaatacttagaataaaccatttccacgtgtagcaggggagcattcagttggacagaaaagtaggtaattctttgaacaacagaccatgccaatgtttttacagttgccgtctattattaaatttcctactcataatcctattgaatactttgaacatggaggtgttgttggctgtttggtattaatatttatgatatcctattttcacctaacaataacatgctttgaaattaggttgtaattcttgcaagcatcttgcaatacaatttgagtataatttctatatgttgtcggtgtaacaaattttaaactattaaacaatcaaaaaattatcttttaagacttttaagatatattattataagagtcgtcaaaattattatatattagttgaaagagagaaattacactttgtgtctatttttattttttaaaataaaaagtaaaaaagaaaaaacagttgaagaaaatagtaataataattacattttaaatattcatgaaagaaataaaaatagttatatattaaagaataatctaagaatatgaaatgtgtatagcaaatggagtaattatctttaatagttatagattatcatttctgattgattaaaatacagatactttactatatggttacatatattactcatacaattttctctatcatgctctattatgacatcaaataatcttacctaacaacgtttgatttttgggtattgttgatgcagttttcaacacggacactaaccactcagtgattcaaacatacaatttcactacatacaaagaatgtgactatgatgatgcacaagacaaggacacaacccaatggtcagcagctgatccatccaacacccaaacacatcctgtgacagtggcagttcctttggtgaaggaagggatgacatacttcttctcaggtgattatgatggtgaccaatgcaagagtggacaacacttcaaaataaatgtgacctatggacaagggttgccaaagagtcttaaatccccagaagatgcaccatctcctgctagtcctgttgctggagatgatgaatcagcaccggacactattgttccttctaatttcagtcaccccaaagaagaaagtgatgatgacaaatctagtgatagtgacaaacagaaatctagttctatttcaatctcaatgtatgcacaacttcacattgtcttactagggatactacttttcttgttttaaagagtcgagatttgttttatattattttttaattatagatatatgctactattattttatctatttttttattgggtgtgagtgagacagtgggttttgagttgagttgtgagctaggatataccatatgttattgctgtaaactaaaataatgtaacaattaattacaatcctttattgctatatgagtttcaatttattagatcatatatacattgcttgtccctttatctattctcgagttttcccccctcctttttctattgttgctggcaacttcaagagtggtgaagaattagtaaagacaaaatacatggtgcctgaggaaaggataaaatgagacataaggagggagttggttggaggttgtaattattgagataactaaaagtaactagaaatctgtttgataaggaagtgtttttgaaagattttttactgagtaaaactatattttcaataaagtttcaaaagctcttctaacttgtacttatataggccctaattggttatgttttgtttattagcactactaaaaaaaccactaaatcattaataatgtcggcacctacccatatcaagtatgatgccatgacatatgatactttcatgtaaattcacgtgattatattttatgtcagggtatgtgaaagcacgtgtagcggcataaacttattttttctcaactttcttgacttctctagctaatttctttaggcttgatttttttaaagattttggagttcttaatattctaggcttctcttaactttaaaacaccattgtttaatgttttttaagtaagcttacttcacttatactacaaattttaacatttttgtattgagttatacagtttaattagtttttttttattaaatttataatataaaatgcacttgcatccaaatttaggatttcattttgccattacatgttcacacagacatttcctatgtgttataattatattttactctttttgcaaacattaagtctaaagttataaacattaagatttaagatttttgtattcatttgtcgcaaacaaatatttcctataaaaatgttttgatgaattgtgaatttgtaatggaaaatagagaagcgagtaatctatatctttgggttgagagagaataatttttcaaacacatactaaatttagggctggtcataagaatcaaactatgacatatacaaatgtgtataaaaactaaaccaaatattgagatccataacaactaaaagaagaatagtctcaatgataatgaagaacaactacattgttttttactctttacttccggtgttccccaacaacacatttttctttccactcttccctcacttgaactaccattaatacatgtatgcaatggagcttgtcagtgtctttgtcatgcccaacgacgacgcttcaatgacaatggtcgccgccgccgccaccaccacaaccaagtggttcaaaattgttgttggtacacatatgctctgtcccaccaaatttgtcccaaccgacgttatcatctttggagatgaggaggagtaacaatatcatcacacgagattcgcctcttaaatttcatatctgaatcatatctagatcatggcgaaaggaagtggaggaacgacaaagagcgtgaagggtgatgaagagtacgattcccatgcaaaatcaccaccactttatgcattcttaaacaatgaaccaccaccaagcccacttgtgtgtgtttgtgagatttgggtttcgtttgcaaaacactgcattaatatgagccttcatttgtctcagatctgttggggttagggttaggcttgggtttgacataaaaataatctagatatggtttttgttgtttgaagaagatgcaagcatatgcaaaaaacacccttgggtgagattgggatgctacacatcttggggaatgctttgtcctctgataagattgttgagccaaggcatgccccctttgattcctggcatggaggttaagaggattgccatttgggttggggcttttggttgtaatccctttgattttcattataaaataaagatagttgcgatttttagttgtgattagagtaattatttcaaaatttaaaacaataccaatgttgacagaacactaatgttatgaacaaaaaattgaagaaaggaccaaacaaaaatttgataatttattagggacaaaaacatatttaaacttttaaaaaatatttattttaatttttaggtatttatttcaactttttaaaataattagaagttgaaaaagaataccaaatttgactaaattcaaaagctattttaagttatttctcataaaattatttaaagaaactgaattttaaaattgtaaacaaacataaattagattttttaatctctaaaatattgttttagaccataaacactttattttttaatctctttgcatgtttagtttcttgtagatggtgagtcaagtcaaaccaagtttaactcaaaagtaggttgtttggtaattaaaataaaaattatttcaattagggaaaattatggtgggaaaaacaagttaacactaaatttagtataaaattttaggattgaggtttgaaaaaaattggagattggagttctgattcatggtttagtgatttgtgatttttcttatcacaagttatcgatttgaattttaaattatgttttagtggattgttgattttgtgtattaaggattgttgattttgcttggtgcgtcaaaaaatttattgtgtcttatcactaaaaaatgtctcaaactaacaacatttaatagtgtgattgttacattaaactagtaatctatattacgagcccatatgtctcacataatcactattcactcatgttacacttgatgaacacaactaaaaacaatgacaaaaaatggttaagaactaagattgataaaaaaattatcttaggtactaaagttgaattacataaaaagatgagaggattaagacctagaaaaattgttgagaggtaaaaaagtgaatgtcatgtgacatgacaatttatgtaattgtcaatgacattgctatatcatagctcttacttttggaagcataaaattgaaggattttttttttttttaaattagtgagtctcacaacttcattaccactttaattcaaatatttattctcaattccatttaattctactttaccaaacaaaagcttagcatacttgttgtcaaggacaaaaaaaatgttgtccaaagaaattaaaattggtcaattttgttgtttaaggattaaaaataaaatttgaaaaaaaatagtttccaaatacatattcaaccccaaaataaaacaaaccctagagtttatagattataaatgcaaataaaggcctgctagggtgaatttatttaaacttaaaattcaactttaaaataaatactttttatataagtatttttttaataaatgaataaaatttgcttcttaaaataagaaaaaacctattttttagtataaataatttacataaatatactaaaaaataaaaatcacttattttattaaaataaatacttatttcagtaaataaattaatcatatttaaatcataagtttttttttgagagtttttattaaaaaaatatagtttttttgatagagaagttctgaattgagattggcctagttggaattctcttccgaattgggcctaggggtgacttgaagaagaggtagagaagagcgactagtcctactacgaagcaagagtagaaagcagtcgtagagggcaagcagcgactctttctaattcatatttaagagcacaacaaataagagtttgagtttgttggcgaagaaaggtatcacagagaaaagaaaaatggctgaatcatcgtcgtcgtcgttggcgaagtctgacgcggaggtagaagaaatgctggatcggatgctgactcgtttggctctctgtgacgattccaagctggagccgctgctctccaagcttctccctctctgcatctcctctctctccgcgcaatccctcgccgttcgcaacaaggtcatcatctgtctcacattccatttccgaatcaaacgcgtaaattcgtcgtgttttggttatgcatatgtaattggttacatgaaaattgaaaatatctctcatctgctgttgcgattgctgtgtgaatcgatagaaactatcgctgtttagtgagagtaattttgctttggcatagtaagatttgttgcgctcgtaagaataataacgaagagtttgcgtgcatgtactctttgatgcaaatttgtcatcaaactgtgcgagtgcggacattcgttgtgttttgatgcaaactttatcggctagatgaaataactcctctctgctgttgtggttacttaatgaaccgatagaaactattgctgtttagtgtttactgagtaactttggtttggcatagtaagattgtgttacacttgagtttgcgtacatgtacaactgttttgcacggtctatttcatcctctttgatgagattttgtgaagcgatttggtgaatttttcatgattgttgacttgtgtttctgacaggtgctcgagattttgagtcacgtgaacaagagagtgaagctccagcctcaaattggtctacctttgtctgacttgtggaaattgtattcggaatctgctgctgtccctatcataaggaatttctgcattgtgtatatagagatggcttttcagcgtgttaatgcaaaggtctcttctcgttctatatatcttagtgctgtttgttattattattttgtggctttaaagtcaattttgatgctgataattcttttttcagcagttttttaaattttcaaaagtaaattatgttttgttgtcggataaatagataaattgattggtttgggactctttgaagaattttgttttctgctattgaatgcttattgtggagactatctgacacaccatgcattttgaataggaaaaggaagatctggctcctgatctcttggtgaacatctcaaaacttccacttcaacaccaggaaattatccttagaatcgttgttaaggtatgaacatccactatttaactttgatcaaatcttccattgtcacggttataacttaaaagtacagtcgtagaagacttttcattgatcattttcatggtacacagtttttgagttggtaatattaattgttcagtgcattgggaccctttttctccttattctatccaagtaaggcttcagttttggagaaatttctttcaagggaattgggaaggatataaaaaggaaaaattagagggaagttctaagtttttttgcttgggaattgaaataaaaggattttttgatgggaagaagggtctactaccaacacttaagagaacttggatttcttgaatccatgggcttctgtccagcatccttttttaaaaggaaatttcttggtctattttcattgtgtatatcttagttgttcttttgttcttcctttcactatcctattgaatagcaaagatcaccctcagttataaatcttcaggatatgactacttatggatttctgcttccttctaggtaattggtgaatgccactctggtcaaattggtgatgaagttgctgcaaagtataaaaaagtgaacaattctcaagatagggagctgtttattgagttttgtcttcatacaatattgtaccagcgggtctctcaaatgtatggaactggatttatgctaaacggagcttatgatatttgaatttgttctaacactagttagtcttttaaattcctatttcaatcaaatggaagtttgatagagtatatagtatgtgcctttgtttatgcgcatgttcctgttactagttgctcttcattgtaaattgcaatctagaatgttcataagttaatctgttcgtgttctgttggaatgttggtagttgctgtaactgtcagtgagtaagaagtttgttgaacaaagttaaatattgtatacataagaatcagaatactctgaatccatatataagataagaatagaaagtgaaaactcagttttattttcacaaagattttgtctcagattctctctctctctctttagaactctatttatagatcttgttctgttgcagtggtggattccctcctgggctttcagtagctcaagtcaatcgtgttacggggaaacaacaattgcaaagtaatgaaattttactaagaaaggtaagttaatcatgtaatggttttaatattatcttaccatgtgaaggtcgaataatatatgttgttgatgttgtttctttagttctaaaaactgataactccctctactactgctatgtatcttccctcacatttcttctcttgtcagaagaaacactgtctaattcaagaatccctcatctcaatatgatatgctatttacttttttcccgtagaatttgaagattgttagaaaatgcaggaagagaaataaaatattcagagagttagagagaatcagaacctgatattattgtgttgttctgaatatactgattatatgatatttatatacaagtcataatactagatggttgtaatacaaataaatgagagctggagctcactttcataacggacatgctaagctagtatagttgttttgataaccaaccaagcaaccgttaactactgcaaccgacagagactagagatcaactattttactctgacccataactgactgagactaaagattaactattctactctgacccatatgacctttccaaattttcatttgaatacactagttaacatgtcagtatttccatgtttgaacgcatacaatcatgtccaatcttgcatttactcagaaagctacttaatctgtcttattttgttctttgttggtgcagttgggtattttgaatgtcattcaagctatggagcttgcctctgagcttgtttatcctttatatattgctgcctctgtagattggtatgttgtagttcccgtgttactcaaatcatttttaacactttcttattaacttactgattttatatccttttggtgtttcatttgtggatgatcacatgtgttgcttgatcaattaactcaagtgaagagcctgttattaagagaggcgaggagcttctaaagaagaaggccaatggtgctaatttagatgatttaaatctgatcaacagattatttttgctatttaatggtatgttattaatgattgtgttaacatatacagaaatatgtttttgcaaattgattttttcttaattttgttcacgatcatatgcaaataggtgaaagtttcacctgaatcttagatttgagcctgcatgattcttacataaattagcttttaatatttgtctgctcaagagtataattgattcaaatgaggttgttcctaacttcctattatttttcacatttcaattaattaatgtcatgtgtcttctgggcaactttttgtgctcatccttcatgtttgaagtttgaactgtgccctctcggtgatcttcaatgctctattacttgctgctcccatttttcataattaaggctatttcaacacaaaggctaaagggcctatgcattgtttatgctcttgcatgaaggtgtgaaaaatagaccattctaattcttagttgttcacctaacaacttaagctattaggagagttggtctttaacatacactatatgaggagtcacatcactttcagtcctctttttgtgtgctaacaagtctttctgaaaatgtggagagataaaatgggacaaaaggtaactgcttttgttcatggttatgattttttaaaattatctagagattgtaattcactacatttgtgtcctatttttttaatctactatgaaaatatatatattttttgatccgcaaaagtatatattatataaatgagaaaaaaggatagatacaaatatatgaaaacagaaacagtccatgataacaaaaccagcctatggcaatctaatacatagaagacatgaattaaggtgccatagaaaggatggacctaaaacccccaagacaggtgagtaatttttgatgaaaataataattatagaggatgacatcattgtaatttttgatggtattagtggtttttttctcccaggtcatagcctattgtggtgtgtttatgtttttgatagcaatactagacatttattgtgttatttttatgtccattttgcgtgactttcattttctattttcagagaactcttactatatcttgaaagtgtattcatttttctgcccatgtctaaaacccaatttggcttttatatatttctctgttttctcttcaatatttatacattattgacattgaatgtaggtactgttggagttgaacatattgattcagaatcaagagtgagtcccgggagtcctgctttaaaggcaaaattaatgtctatattctgcagatctattgcagcagcaaacaatttcccatccaccttgcagtgcatttttggttgcatttatggtagtataatattcttttatttaatgattttgagcttatattttctaatattttttcaccctcttcaaaacttgtaggccattttgttgcttaagaattggccaatgtagttaagattttatattcatccatgacacatgcactatagttatgagacttgtccatttgtattaacaatttcatggcttggcctactgtgtctatgatttttgtatatatgatatctaatcttacaacttgtattacttttatagttttatttgaggttgtttgattttttttttccctctttttgttagtttgtggaaatagattctattatgagaaaggagaagataatcaagatatagaaaatgagaatgtgcaaacccttaaagatggaaataaaaaaagtgatgagataatatttcttttgtgataatattgtttctttgatttaaacaatctattcaatgatcccgtgcaaacataaatcatgctaatgaagcccccaatttctctaatcttcaacaatggtatacccttaactaaatcatggaatgaacactgaaggtggaaaatggattataagttataactttgtaccaattatagactatgcaatcttcctttgtaaattttaataacaaataggaattttatatttttatttattgcttataatgcttctttcatattaacaaagtttcttccctttcatataggtttagaaattgcaattttcccttgttgttctaaacaaagttcttatttcattatcaaaatatcaaaatatgagacatacgaacgtgtggatcgataattgggttgtctgtgcagattttattttgctctgtcttttttctactgttctattttgtttttcagtttttatctttgatttgtcatattcttgaatttaatagggaacggtaccacatcaaggttgaagcaattaggaatggaattcactgtttgggtatttaagcatgtaagtgcaatatttcttggcgtttgttttttgtcataaattttacccatagaataaaagtctcttggcctagtaattgtttggaaactagaaactatggttacaacataggacatggatatatcacactggcatagggatataacattttaaaatcatagaacatgctatggttatcataatgcaaagtataaaagttatgtaaaattaacataaaatgacccaaatcttaaatcaaaaaagagaattgatgttttaaaaataagcatgcataattgtagaagtcattgtagatataataaaatgctacaatttatctaataactacggtgttttcatctttattggtgtgaaagtttaaaaataaaagaaaaagttgtacaaatatgtgtctgacacaacacacgaacattaatatcgtgctgaagtgtttgtccttccttctttaaaaatgtttcaatttaaatgaaaataaagtctactaaaagataatttttttaaaagtggttcagttgaaaatgctgcttgaaatttgcaatgaattgccggtttgaaatgaattttactttggtgaattctatttctatatctagattagcttttttgtatgtggttttacttcactattggctgatttggcagaaatgtaaaaataaactattggctcaattatgtatgtagttatatattcacattgtgggttaaatttttatggtttcataccagaggtagaatggataatgttgctagacataaaaaccatttatatgctttcgcccaacagtttaagcattttgggattgttgattcgtgcgttggtattggagctcctatgaccttgtggtctagagttcaagccttgttgtccctgttcttctaaattaaagttaaattttagcatagggtagagcaggtgcattgttcatgtttaagcccaataggctcttgcattaggtgggatttgagattgttggttcatgacctatatattcttgttaaaatattgtaaatgaactttttttttttttaaaggcatatttgtacatgaatgttaacttcaccatgatataaaaggtcttatcctggctttaaatctttgtttttcttttgattgaattattttgcttaagaatgccacctctatatgatgaatcgacttaaagatcaactaccacatatacctagtaagaatttaagatgcattgcaaatgatgtcatgtcctcctttgtcccatatatatgtatactttggcagttgcatgttttactatgattttttgttttttactgaagtagtataacttattgtttccttagcatctttaatatctgtaactggaaatgcaggcaaaaattgatcagcttaagttaatgggtcctgttattttgagtggaattatgaaatccctcgacaactatccaagttcagaagcaggtttgctaaagacttgaaagttctttttaatgttatttgaataaaattagtttattttacatttaattttaagtattgactcagatgccagtgctcgggaggtcaaaacttatgcatttcaggcaattggattaattgcacagcgcctgcctcacctcttcaggttccaatctctttatttctcatggtcataattttagccatttttgcatatttcccccccttttaattggtacttatttgtgcggatgggaccaaaaatatgtttgaaagtgctgaatggtgcagaacatttgaaataaagtaatgaacaatttataatatatttttaggaaggttaaaaatgaggctgatagcccttgtgccttcaaaggatattgacaattgtgccttttaatgtactaaaataaaacatgaaaacaagtttagccaaaaaaaaaaaaaaaaaaannnnnnnaaacttacctttaacagtgttctagggatcgagtcacataccaagcctacactactctgagaactgaagaaaatgtacatattactttacaacagaagaggcaagcatgtaaaattgaaagaatgattcaaactaaactgtgaaccccattttgtgggaaagtagaataatgggtattaggaagaaatgaaagcactgaatttcaatagagaaaatacaaagagtgaaagagaagagtttgggtgatgtattgtaggggaagcttttctcagatggaacaaagagaagaaagaggaagctttctagagaaagtgagttggaatttgatggagtgtaaaaatgtgtgggatatgaaagcaacttctccctgttagctcattggatttttaaataaaagcattgagtaaatgcttaaagttataggaaaaataataatggttgagggctgtagttatccatccagtttggtaacttagttcctccatagcttgttatttcattctttcaatatatgtttcaaaatctaactattcataagttatcattagatctttctgcaatgcgattgtgaactctcttgtttggacagtgatacactatagaattaataattctcactgttgtagacttgtaggcatcacaaggctctttctcctgatctgtgtattacattatgagatagagctgtcttctttgtttccttgggactgtctgtaaatgttttctttagagatgtttcttctatggtttcaaaaagggattggatagctctctatttaattctttctttttttatcccttttaaatttgcattgttttaggatggtttgctatttgattttttattttattttattttatgtatttcccttttttcaggtaacaaataattctctttaataaaagaaaatttcttttcatgagttaggtcctttctgagttctattaagcagttactaatttagctgctccctgttcttccagggaaaagattgacattgctgctcgtctttttcatgccttgaaagatgaatcccagtctcttcgatttgttgttcaagaggcaactatatctcttgcttcagcatacaaagtatgtacctctttctgccacttgtgtaaatctatttttcattaatattctcagtcatggaaaatgtattgagtatatgactatctgatgtgaaagtgaaactagtttgtcaagtttagtcacacagttatgtttacctcacttgcatatacaagatacatcatatcatgacatatagatattttgacaaataaaaagtatacaattgcttcccctattttcaatgcctcaaaattataccctccattttcatgaaattcaaagatgtaaggaaagtaaattgagatgcattgctcattgtactgtaaaattgcttgttgcaccttcacaagtgtatgctataagaaattataagtcattggacacccaaagttgagcccaagattagctgccattatattcaacataatccatctctttcggaggaaaatgttccatgatttaaccccccttttgatcatcacatgttaattaaaattaatacattagattggataactacgatgaaccaatgaacttatgttttaggtagcggtaaacatgggtttgaacaacatgattaacccgacttgattcgaacctaaacaacttggtttgaccaaactcgtggttcaattcggatttcaaaagaagcaacttgaacaagtcaagtcaggcaacatgtttatgtttgcaaatccgagaccggacccgaccaaagttatgtgtacatgtttattttatttagtatgagacagtgagtcagtgaatgagtgttttcgtattttgtttcacttcgttgcgtgccctaacagcagaagcaaacctgggcgtttccttcttcagtgataaacagcccacgacggttaccaaaccttgcttcgattcctcaattccaagctagggacaatgtcattagactcaaacatggtcgatcccacacgctccgcccctaattttccctaccaatccgctctgctaccaccattgtccattgacgacaagaatcagaaggtcggcgagtttgaaggctacttaattcaaagacttgcagatggttccatctccagatctcccaacatgctgctgtttgtttctttcaataccagttctcagttgactccatccgttgaaattccttacgctgatggattacaatgcagtcgatgcaaattttgtttatttattttccgatttgtgactgttctgtgaatctgtgaccgtctctttcatttccccaatattccaatttaatgttttctgatgggtaacctgagaactgatttggtttgtgacccgaagttagccaagtcggatcaattcaggttgggaccggaaaatggtaacaacctgaaccgacttgacctgaaatccttgaagcaattcagttttagttcgagaagacaaaacccagatcaaattgacccatgttcaccgctagttttaggatttgttttggcttttagttttgatctgaatgaattccttgtccttataattattttctttccttctaacagagtcttatttagccaaatataattaaataatactaacaataatcatttcaacgtattgatatttccctattgtctcttgcactaattcaaggaggtatgaaacatattacttggaaaaattacgtcatttattcaaattaggaaagctatatagtaaatttatggttgcattggtgttatgttggttgagttgaattcttttatttcataaaattagagggtagaaacacaattttcttgagactccttttattttaagtgctatattttttaagtctttcaccaacttaatgtcataactttgaaattctctcaaactttaggactttaggtgttaggctaaacataatattgtgactctgtttacaaacttcagatcatgatctcttttggacttttggttgatttgggatttgaccctcttttctattgcacattttttattgactgaagtacttaactgtcttgtgtatcagggagccccattagccgtgttacaagatttggagatgcttctgctaaaaaattctcaagtggtatgacaaaacatgctgactttcccctcgtatctaggagactgtatgcagatatattaccttgctgagcaagttcatggcatagttgtatttgtatttgttccagttgtgttggaagttacataaataacaaacctactccactttctaagttgcctagatttattgtaacttagggaacaaagttagaattattcgcctaattattctttgttgtaaattgctgcttctatttatttttcctatgtattattctgtacctgtatatatatccctaggatgagtgtgtatgtcaatcaagcaattttactcagattttcttatagagaagctaatatgagccagcttctacaaattgacgtgtgcataaactgattttagcttatgaagaagctcatttcatttttcttctcttagaagtgcttctggagaagtttatctaaacttgccctgtaagaagctagaaaaactacaggatgccaaatgaactcaatagaagattcttgcatttctctccaaccaaatacaccaaagaactgctgcctgagaacaccacatagctttttggcatctttgctataaccaaatcctctgaaattgttactattataattattttattgcaatttttatctttattttgttatttttttcccctccaaacaattgattttccttttatttcttatttccatgtagtaatatccttttttatctaattaaaatttaaaggacatatggtttgaacagtaacatgctgcatggtgatgacaggaggaaagtgaagtacgattttgtgctgtaagatgggcaacatctttgtttgatcttcaacattgtccaagtcgttttatttgtatgcttggagcatcagatgctaaattagatatcaggtattttacaaattcctgtagcaatgaactgacatgctatgatgagttaaagcatgtagtcttcttaaagggatttctcttacagatattttgagcaaatgtttagctttgcttggtgtttttctttgttttttgtgtttttccttttactttggaaaagatcccttatcctcccaactgattttcttattttatcaacaaaagaggaaaaaaaaaaaaaaaannnnnnnnnnnnnnnnnnnnnnnnnnnnnnnnnnnnnnnnnnaaaagcttttagataattttccaaaattattttccaaaggaggtgcaattagataatgaaccctttattacatatttctttcaatattgcatcaaataactgtttgagcctcttggcaaatcaaatgtcataatttctataaagcatgtacagaacatcataatatgcaaattaaaatgtatgtggcatgcataattgtagtttttaaagactattttgtcttgtaaatgtgttaaattttaataaccatctttcttgaatttgtcatgtcctcagattgtatggcttttttaataatcagagactctgattcctgtaatgtgttttttgttgctataaatagttacttttgttccatgttgatgatttttgaacttttttttttttttttttnnnnnnnnnnnnnnnnnnnnnnnnnnnnnnnnnnnnnnnnatttaggtttcttttgtaattaagtgatgatgttttttataacttgaagtcttataaatcatattaggttttgttttctggtttgaaacagagaaatggcacttgaaggtctttgtcttcttaaaagtggaagtgaaattgttggtcttaagtatcccaaactgggtatgatgctggattacattcttcaacaacagccaaagttgttggagtccagtgaaactagagaacagaaccttctttttccttcaaatacatatgtggccatgattaaatttttattgaagtgctttgagtcagagttggagcagaacaaatccttagaaggatcatctgaatttatttcatcagtgaaggcattctgtttggttctcgagcattctatgtcatttgaaggctctgttgagttgcatgtcaatgcttccaaggcattgcttataattggatcacatatgccagaggtcagttgtaagagttctttgattactttcttgattgtgttccttctgacacatattgttataggtggtagcatcacattttgccctaaaagtttcatggcttaagcaactactaagtcatgtggattgggacactcgtgaatccattgcacgcatacttggtattgtgtcttctgctcttcccatccctgatgttatgtctgaattgacttccttattcagccaaacacacaaatcaaggtttgtatactggtggaactgtaattttttaggtcagtttatgagaattgctgctttttacctgttttatatatgctcatgttgaattaatttattgataggtttgagactcagcatggagctctttgtgcaataggatatctaactgcaaattatttgtctataacacctgtaagtataattttactgcatttttttaattagtaaatggattagaacactataaataagctttagctgggatcaataggctttaggattttatacttttatggtttaacacaccttttgcataaaatgctagttttatcagtataatctttgagtcatgtgtaattgtgacttgtgattttgatcttgatcaacatgctgccctttgagcaaatgccttttctgaaatatactttgatcagatgaaactgaaatcttaattgttgggtataatcatgtcattgctttcactataaatatgtttgaattttgtgtatataaaatgatcttcgcagatgccagaaatacttctccagaatacacttagatgcctggttgatgtagttaattctgaaacttctgcactggctgctgctgcaatgcaagcactaggtcatattggactacgtatttcattacctccacttgatgattctaattcaggtaaactcaagtctaataagctgatgtacttgtttggatttggacctagagttgagctatttgttgatctattataaaggtgtctgattaattctgcagatggaattctgataatgttatctgataaattgagcaagcttctctcgggtgatgacattaaagcaatacagaagattgttatatctattggacatatatgtgtaaaagaaacatcatctactcagctagatatggccctaaatttgattttcagtctctgtcgatctaaggtaattcagcttctccctcgtcttttatatcatttgcttattatcagtgtgattcatgttggattgatgtttactttgatgtttctttgttttttgtctcctgtttcaatttattgctccatcttttttttttttttttccttctttccnnnnnnnnnnnnnnnnnntttatgttgtggaaaaactagattttggtttttgggatgccttgatcttgattaaaaacaatttgaagtttttttttttcattttcttttgagctaaaatgtccattaatgttaatctttttccattataagttgcagcgactaaaaattgtcacatttatgtaactgaaatttcaggttgaggatattctcttcgctgctggggaggccctttcttttttgtggggtggtgttcctttcaatgctgacataattctgaaaactaactatacttcactgtcaatggcttcaaattttttgatgggagatttgaccgcttctgtatctaagcagagtactaatgaacaaagtgaatatagtggagattatcacgcttctgtgacagatgcaattaccaaaaagctctttgatgttcttttgtatagtagcaggaaagaagagagatgtgctggaactgtttggctagtatcacttataaagtactgcggcaatcatcctactattcagcgaatgcttccagaaattcaggtttgcattaagaaaacaattttggctttgtttaaacttgctgaatttgttaaaggtgctcgtatgagtcctttctgaattttattatgatggtgggagtgtgtgtttatctggattccagtttataacctttggtgcccaagcaggagtgcttggtcaaggttgtttgctgggctgaggttcttccatgttaatattctaaattgttgttgtaattgatatggtggagcttttcttgttgtgaaaccacaaaatgtttcctaaacctggttacctgggtattcttataatttatattgggttaatagtgtttttagtctccgaaaaatggtcacctttggtttaattcccaacttttaaaaccataagtttttgtctctatttttttaaatacccactaagttagtccctaaagctaacactttagggaatgaaaacttacggttttaaaagttggggactaaaaccaaagatgtccatttttcagggaacagaaacaccattgacccatttgttttatatgatgttcttgacactgtatctattttgtagcagaatcctgtaacttgtaatatttgatttacaattatcatgtaaatgcaggaagctttttctcaccttcttgctgaacaaaatgaactcacgcaagagttggcttctcagggcatgagtattgtgtatgacattggtgatgaatctatgaaaaagaatttggtgaatgcactggtaaataccttgactgggtcagggaaacggaaaagagtcatcaaagtaagttgttagtctagtcatattttataaaaaaaaaattgttttttgtgggataaggcttgatggtttattattttttgctctcttcctttaattttgttgtttaaaattacattcctgaagttttgtggtgcagcttgttgaagacactgaagtatttacggatggagctcttggggaaagtgctagtggagggaaactgaacacttacaaggagttgtgtagcttggcaaatgagatgggacaaccggacttaatttataagttcatggatttagcaaactatcaagcttctctgaattcaaagaggggtgctgcttttggcttctctaaaatagcaaaacaagcaggggttgttcttaagccatatttacgttctttaattccaaggcttgtacgctaccagtatgatcctgacaaaaatgtgcaggtaagtgccatcactgccagaaaatcagtggtagagaataacagctgcccccaaccccaagtttctataacggtttaacgctttgttccaataaaaaacagaaaaggaatggatgcacacaagtacaatagcatttgcattgcttctccagttctttatgggttcagttgaaagtcaaaacattaaaaaatgaaacttactttattatcttttgcttccgatttttatttataatctggtaagcctggtgttgaatctaattcttaccaatagcatctccagtttaacccagaaaaactctctacccagttttgatctatgatagaacataatagtactatataattcatgccgttgttttcgaacatcaaaatgtagttttgccgcataaaattgtggtttggttctctattgtgttccatgtaagatttttctttttaaactttcaaaaaaataatgtgcagtttgtattttattttattttttttttgcctttttcaataaacaattcctcttttattaaaaagcaatgttatgcatgatatccaatgagtatatgaattcttattttcagacacttatttcacttgattattgcatttttttctgtttaggatgcaatggtacatatatggaagtcacttgtggatgattcaaagaaaaccatcgatgaaaatttagatctcatcattgatgatttactagtacaatgtggatccaggctttggcggtcacgtgaggcatcatgtcttgcccttacagacattattcaaggacgaaagtttcatgaggtcattaacatttcttttgtttttcttgagtataaataagcatacttagagttgtcaatgatcaattctatgatagaaaagaaatcctcaaaattattgtaatcaactaattacatgtagcaacaaaaaccctagtcactgttatggtgaggcactatctgtaaaaatctgagcaaaattttagcattattattgttgtgggtttgtgatgtttgtcaaaggagaagaatggtgccagttctggccttctgttttttccttcccatttttgtcgagttgttcacggcattatgtcggtataaaatatggtttataagtttatttagggggctttcaagtgttgatttgaagagggattagatagctatttatatttgatgaacaattctgtttggtatgttttgtttgatctaggaagttttgtttgatctaggaggatttttgttctcgttgtattccttttctataaaatttcctttaaagaaaccagttagtcaatattcctctttttagttgtaatctaattgttgcttatgcttgaaaaattaagcagagccagttgtgtatcttatgtgtgctaataaagtctgatttgcataaaatgtatttacgagagaaagaccatattatgctgaaaggagagttaaaaagtgaaaaagaactggcaatgttaatgatatactagaacctgagcactggttgattttgatatatctgaagctgtggagcatatcagcatgtctttattcttttttgtgtgtttttatttcatcttgcaccacccacaggttgggaagcatttaaagagattatggtctggaacatttcgtgtaatggatgacataaaggaaactgttagaatttctggtgaaaaattatgccgtgctgtaacttcgttgacaacaaggctctgtgatgtctctctaactgatatgtcagatgcgcacaaagcaatggatattgttttgccttttttgcttgcagaaggtatactaagtaaagttgatagtgttcgcaaggcatcaattgcagttgttatgaagcttacaaaggttaggaatgtcttgctatgcggtggcttttcaacttgtgtcatacactcactttccttttgtttctctcttatctttctgcctctggattgtaaatatttgtgtattcacatctcaagagttgtttgtatttcaaatcttattgaactttgtaggggtgtatatgttttcttggctctagtgttttattatctttccttttgtttgttgttttttatcatctttccttttgtttgttgttttttattatcatgggatgtatatgttttctttgtgcattattccaatgatttttcaggtgttatttttttggacacttagatgggaggtccatcactttctgatgttttgttttttggtactatgttctttgtttaatcgtttaaggagtacagcttatcctattctcttgtacttatatttttcaaacttctttcccaaaaataaaaaaactaattagaataccaaatgtttgtagaatgtatttcctggtaagcatgattagtgctaacctgcacatataatacattacaaagtttaaatagcattcacagttttggatgtgtttgttgtctctttttgttttagttatttagtttatacgtcatgaaatttctggtttgtctttgactttgtttatctgattgtgattgtgtaagattaatgattgattattatggaagtaaactataacagtgctgttattctgctgttaaatctgagtgtgtctccttttagcatgctggaactgcaattcgaccacatatgtctgatttagtgtgctgcatgcttgaaagtttatcaagcctagaagatcaatcactcaattatgtcgaggtttggttgaatgatatattcaattcttccacaaattcaccattaattcttgtttattcatatgttaactttttatgtttttctttttatcagcttcatgcggcaaatgttggaatacagtcagaaaagcttgaaagtttgagaatctccatagccaaaggctctcctatgtgggagactctggattcatgcataaaagttgttgatgcagaatcattgaacacattgatcccacggcttgctcatttagtgcgatctggagtgggccttaacactaggtctgttattaacttattatcacatttcatgcattttcttttgcattgtcttcctgcttgatctgtcttgagtcattttgttattgaattttcccttgaaaatttaaggagcttatgttggttcaaatagggtgagtttagtagaaaaagcatgtaggattagtgacgacaaatagatggttgatatttgcagtgttttctgtattaatatattgtcatccttatcacgctgatgctccagctttcttgttttaataaaaaaaaattacattcctttgcttttcctattccttctttttgggaatattcttccctataattagttattctttctgtgcttgtgcagggttggtgttgctaatttcattaccttgttgcttgaaagtgttggtgttgacatcaagccatacgcaaatatgttggtgagattgttgtttccagttgttaaggaggaaaaaagtactgctgcgaaacgtgcctttgcaagtgcctgtgctaaagtcttaaagtatataccagcctctcaagcacaaaaacttattgaagatactacagctttgcatgctggtgacaagaattctcaaattgcatgtgcatttctcttgaagagctattcatctatggcagcagatgttgttggtggatatcatgctgttatcattccagttgttttcctttcaaggtcatgaacattcttattttttctgatgtgatttattatgtggatattttataaaaatctgatatttcgatattatatcaagccaaaatcataaatttaagcagaagcttttgccattggctgccagtcactatcatttagaatgatttgtttgttgtttattagagtattgtacagagagttgcagtattcaactgcactctcagttaaatcagttagttaggaattagttaggagttagttttatgttgagttagttagtcataactatctaagcctataaatactgtttgtaactcaaagttcagtggccaataatcattttcacttctttcttaaatttctctctctcaaaatatcttctactatgatctgttagaactcttttattgttcttggagaacattgggtgattcctttacatttaagtagatgtggtcttcttggagttcattatgatgcttatgtaacaactttatttgtctgttatattgtggaatttgcaggatttgtttcgttcttttgtttttcctataatttctcttgtaacaattcaaaggatgtactaatctctttactgttgcattctcatcagtttcagaaattatttcatgctccattaaaatttaaaaagaagaatcttgagaatgtattttgcaaatatccaagtctaggtcactttagagtttctgagtaccattaccatgtttagtaatcacattttgctgaaataacatctaatcttggtaatggtggctactgagaaatttatgtaatcacattttgctatttgggtacttctggtacctttcattaatatatataattttttgctgacaaaaaaaaaaccatgtttttgtcccatttagtctggttatagtatcctttattttagtaaattattagtatggagaacaccaagttctttcagtttcattgaccaactctcttaaaagtttaaagttaggtggagggctgagaatagttttatatttctcacacatccccctcttgtgaaagatctttggcttagttcatggaaaaagcacaggccaaagacatcttgtctctaattataatttaattcgaagaatgttcacatcagcctcaaggacccacacttgctaaaagcttaagctcataggtggggccaataatggattttatatttaatgttggaaaactatgtatattgttttaggcatttgattctgaattttaaaggtacttaaggtaaactgtgtttattgcatgatgttcatataacaaactaaacttcatattgaatagtgaaagtatttcttattttacatgaactaaaaaatgtcatgcagatttgaagatgataaaaatgtctccagcctatttgaggaactatgggaagaatacacaagtggggagcgaatcactctccacttgtacttaggagaaattgtttttcttatatgtgagggcatgtcatcatcatcatgggcaagtaaaagaaaagttagtctggccttcttttctgcattttatattattttgatatagcctcatagaagctcggtgatttcatgattcgtgtataaatgtttgcttattttctgctgttttgcgtgcagtctgcagaggctatatgcaggcttagtgaagttttgggtgaatctctttcttctcaccatgaggttttgcttcagtctctcatgaaggaaattcctggtcggctatgggaggtaaagtaatgaattttgctttggttgagaatagtgccacttaaagtttttacatgtggcaggaaaaattattacgaaaaattaatcaaagacaaattgctcaagtttcatgtgcttgttttgtcttattacatatggcagggtaaagacatgctattgctagcagtaggtgctctatgtacatcctgccataaagcaattttggctcaaggttcctcatcttccattgccattctgaatttggtatcatctgcatgcaccagaaaggggaaaaagtatcgtgaagcagcactttcctctcttgaacaggttagtaatttatagtgggtgctggttagtaattttgggaaagttttctcccttagggtaagtattcaattgaaaagcaactagcattcttgctttttgaaaaccaactccgtctccattgagacaagtgaagatatgtacattattgtatgttctgtataactaacatgataattcattgttattgttaatcagttatgaaatgaattgataatggcctattttttgtagaactgtctagagaaaagaatgagtaaatgtacgaaagaaatttgcctgtactagaaattggcaaaagttatttagaattgagatataagaccccttcaggtttactttgccccttgtataagtagctttgcaaggttgtgcctgcttgtactggttgttgagaacgtcatcaaatattcaagcaaaagataaattataataaaaaagggagaaaagtggcaacttaatctataacaagttatggacccaaagtattaggaactatctaattctataagagtacagaacagtgacgtcccaaataagtattggactctataatgagtttattttttgtatgtttccaggttataaaagccttggggaatccagagttctttaatatggtttttcccttgttgtttgatctatgcaattcagagcccctaaagtccaggcaagcacctttggccagtgatgctgctggatcaggttatgacaaattctggatcttcatttatatcttgcaacagtttttgttcctcatatgagactgtatggtcaccaatgaaacatttaatgcagtttttgaagtgaagtttctcatgctaagggcccgtttgggttttttttttttttggtttttggttttcaaatgcaatttccaaaacaaaacgtgtttgacaaaaatggaactgagatgatttttaactcaatttcaaacttactcattcattttcaaaaccaagaaaaacggatttatgaatttggtctttagttttaaatatgtacattctccttacattttacaatgtgaaccttcccttcccaccacccccaccatagccgccatcactactggcaccggcactgccaccacaacaacctccatgaccacgggcaccaccatcgccaaccatcactaccgacattgccaccatcgttgttgtcagtgttgtagtcaccgtcgccaccacacaaatacacccttaaactaattttaataggatcgaaaactttcaaaatgagtttattttgaaactaaaaattagaataaaaaaactaaaactgaaaactgattttttttttatttttttttttaattttgaaacttacaactaaaaatcaccccaaaacggagcctaagtttgtttagtttggtgctgattaaacaaatagttaaagagtgttgtttcttgtatgatattgttaaaatgtcccacattggttaggaatatggctagaagccagaattgagcaatcctctccccttaagctaactttttgggattgaattaaacctattccatttctaatatatactgtatgtagtagtgttggagaataagttccatcaatgaaaataggacacaaagtgaagcattttttattgttttttattttcattttttgctttcactttttcctatacaaatttttgaaaatagaaaacgttttgtcaaaccaaacatgaccttagtatctagggacttgatgaaatggatgattctccttgtttgtgttactgttcaatggctatttcaaatggccagccacttgactaatttgttctttccttgttacatcgattcctgtcggagctgctcagtgctactgactacaagcattttcaatggctatttcaaatggctagccacttgaataatttgttctttccttgttacatcgattcctgtcggagctgctcagtgctactgactacaagnnnnnnnnnnnnnnnnnnnnnnnnnnnnnnnaaaatagttgactgtttaacctcttgtatccatgtggcacatataaatgatattcttgaaaaacaaaagggcttagcgcacatgtatacagcattcttgttacctgaacataaatggactggtattctttatggctcatttttcatttttcgaagtcccttccatttttttctattaatcttaattaagaaagctttctttgtgcagtcaaaactacagcttttgtatccatcagagaactttgctcaaggcttcacaatgttgtgaaggactcccagggaagtaacgaacttgctggagcaacttcctttgttcaggaggtaatggaggcttactttcagttggacttctaataacttcaattcttgaatgatctaaaatcaactttatttttcttcagatatttcattctctggcaccaaaaatactacattgcataagcacaataaaaattgcccaggtacgtcactgtctttttttattttatttattgacatgttagttgttagtttttgttacaatgttagtggaagggattcgaatccacaatttcttctttttcccttttcctttcaaccaccaaaccaaccctataactccacgtcactgtcttgtttggttgaacattattcatcagttagattcccctgccttatagaagtcaaaaaccctgaaaaggtaatcagcatttgtttggtattaatttttaagtttgtaaaatcttatatctgaacgctaggcacattagttgacttcaatagacaacacaattgattataatgccatgagtcagaagtgcaatttaaactgggaatcatgcatattttcattgcattcctttaaatatttgttaaacgttatttatgaaatgtttactgaaacatgttccaaaaatttgttctctgtttgttatgtactaatatatttgccatcagtttgtatgcatacgagtgtctttctttttctcatgtagaacttataaggttggagtggtccagacaggtgaataaagcccagtaatttattttagtttcacccaatctttaatactaaatgcaacaaatactaagtgaaaattactacacacattacatttggttgccatatctagcaaaagtggacttgggaataaaactgaagtaaaataaattttttgggaatactttaaatttcaaaatataacgaacaaaactgacagaattgccaaaatttagggactagacgtgtaaactttttctttgcgtgttcatctttaacaagtggtgattctttcagtaatctaattggttgctgataattttatttcatattctgcatttcttgtgcccaaaatcaggttcatgtttcagcttcagaatgtctactggaagtcatgaatcttgccatggacgtcccttcagttggcaccatcaatgaaggattcaaggacgagctgcttcatcagtacgagatagagaagaacgaaggagcaaagtcaatattaaaaaagtgtgtcaacattcttcaagactggaaatagtaaattgtacgagctatagctgtaaccctcatttatgaaattttgggtggatgaaacatttactatgtatagctcgtgcttggtgtagtaggtccacatatagcgatgacaaaaaaactagtacccttaggtgaaatccgttacggattgaatttttaacacgatgagggtggatagcaagtatgtatattttatgaatattcataatttgaaattacttaaatgtctttcattatattttaaaattatctattttttttttttacctgacttgtgtaaacaggtaatatgggcaattgtaatgatatacttagatggcagatgctcaactttatgttgtcttctaggagatatgcatttttttaaagaaaattattacttatccaaattattgattattatgacaatattttttctattaaaatattcttattgaaagagttgaaatatagttgtgaattaagtatttagagaacgtattaataaggtaattagttggtgaccccaaaaaataaggttatatattttattgtaaaatggtgtgtatactttggaataagagaagagaaaaacaaatattatatataaaaaatattaagaatatttaaataagaaagtgaatagaaagaaaattccacttttcaaattgtatattttgatttataatatgaaaattgatttagataaattaatttattataaattctaatcataatataatttatattattaattttaattacataaaatcgagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttaaaaaaaatatgtttattatattttaatattcatgagaataatttttaaaatttaaaataatttaaataaaaattagtattttttataacaaaattaaaagtaatttaaataaaaaagaaagtcgtgtattagacaaatatcagtttcccatcttctattacgaatataaatattagaaaacatggtaaaagggaaattatagctttctcagacaataataatacctaaaaatactttttaaaaacttgtgacatagaaatatacattctggttttcattttcataatttgaggataaaattatacatttaatttagtaaaattcattcagactgtaatataccaataattagattaagtaaaaaaatacaaaaaataaagttagattaagtaatttattaaggatattcttttttaccccgtcaaatcaaattataatatatacacacttaaaagaaaaactgaatttattaaaaattaaaaacaataattacagtgattgcgtttctccgttctcagaaggttttggtcagtgaagtcttctccttcaacaacaacaacaacaacaacaaggggttgcagtgaacatggatgaagctgaatttcaacgccttctccaactcttccccgttgttcgttctcgcgattacacagtacttctctctttctcctctctctgtgtttagggtttacaacactgtgccttttccttaattttggatctctattactctgcatctggcttctctgcctgttaaagtttcgatttttcagacacccatgttgtgattttcgtaattcacatattgcttctctctgatacaattgtacccttttgcttttatgttggtttaaggtggtagtgttagagtaatgtactgtagtgtctgaattcatgtggaaattttaggtgggtgcaacagactgggttagggtaccataaatatatgagtagggtttagtatgagatattaattaacaaggtcctggcatgaattgggtggattttataagtaaggatgtggtttcagttcctgttgtgaaattgggtaattcacctaggaattgaagttagaggctttggtaggaggtttgagcagtaaggataagattctatggagtgtttgcagatctatggtgtatttgattgaaaaggattgattttgtgtttgaggacattcgtctctatgaagttgtcatgggacaaggttgtattcaatttatgattctacctgggtcccttctcatggtttttttaaaggaagtttctcttctaaacgtctggattggaaagctctcctgttttccactttcaagtttcatctttagttgtatttttcttattattatttagtcttttcaatattatttttaggaagatagcttatcctccttcctttgtgtgttctttctcttttcaatttgaacatactgaaatccaaagccatctctgcttgctatggtttgatggatcagtacgataaattaacttttttttgttctatgcgtgggttgatgattggaaaatgctagaatgatgttaagggacttgctacttgacctattttagaatttagaggcaaaatcttgacctttcttttctgtatctgggcttcctttgtgctcagtttggattatggagaattccttacagttgctaggattttgcccaggaagttgtcagaaccaattattatctcatcttgttttgatttttatttgattcaaagaagattggaataatttcccatgtttagtccatttacatttgtagtatgcacaacattggcattttatatgaatcaattggttttctctaccttaatgcttttacacatttggaggactggcatgtatattagtttctgaacttgagatactgatgcccccagcatactctgaaactatacatgatgcaaaatccaagatttttatttcttagcttaaataatttacaaaattctatatttgtgaatgcattgaagtaccaaattggcaactgttaaatttcaggcagaagcagcatcatccagacaaattgcatctgggtcagcacagaatgaggtggtaatgctgaacttgaatctgttgtatgcattgatgtctgcatatatatttattgttagctaacaaatttgtctctgcaggtaaaggaatggcaagatgcatgggatgaaagggataaggattttgagaagcaaggaattaatcaacaaggtaccggggtaccactatctttgggacttttttttatcaacttcagttttcgagaaagcacatcaaagttcatgagttatatggcagtctgattaattatttttgttataactcataagaaacagaattatgcttttgaaattaatgctatgcttgtgtgaattcttcaaatctacagattcattttggagcaagctaaagtcggaggctgctaggaaggtattctgaaatttacctattattaaatgcatactaattttgttttagaattagcattgtagcacgttattggaaatttggttacacccttgtttaagtccttcaaaagtttgaatatagtaggccttttaatctcaaatggtgaaattttaattgaaaactaatggcaatggctagatggtttgacttaatcttccataagaagagtttgacgtatggaggggtaccttggtttccatttatgcatcagttgcttattattttctttgttgattaaacccaaattctctattttcccatattattgaaaattatttttttatttctagtcgcatatggtatgtcaataaatcagttgttttgcatcattgcttccttcccttggcaacagtgaccttttacttgatttccatgcccagttgaaattttcatttaatggacctttattttgccgagttttttttgggtactttattatgattattttgtaaagatgaggagagaagcattctctaatctaatgtaatggaaaatgtttttttttttttttttttttgnnnnnnnnnnnnnnnnnnnnnnntagaataggtttttcctctctattgcattttctttttcgtaaacctgtttgtgagagctgtagttacatcttaaattaaactattacaagctcttcagaaagtagtgacaaaagagataaggtggttatgttatgtctttagtatttctgctgtataagcatactttgatggggatgttattgaggatccatgacatttacctgtgattattaaacaagtatttaagtatcctttgaatgagacacagctcattggttctaatcttccaacagatgggtccagaagaagcggagagattttgcaaggcgttccaacaaatccataagaaactagtatgtgcaaaataattgtgatttaagtcattgttccaacaaatatattatgaaagatatattttatacaacttggtatcttcttggaaagcattttttgtgaaattgtctaaaaaagttatgcctgaaaagtattattttctatgaaaatggaattttctatatttttaggcgagtcttttctgaaggattgtctttcattgattaggaatataattttgtgaactgcagagacttaagaacattatacatgttttgcaacaaaatatagaaaaataagaaaattaaaatgtttctaatgaaatactacatataattagaagctgagtttccttgttagtattgcatttgtcgaaattttattttcttgttttattttatgttttccattatattttaggtcaatgaagagttgagtttagatgctgctcgaagcttcttaaaatcatcctagagttctaaagaatcacgcatgctttcgacatttcttatgattaaacaatcagccataaattctttgtactgtatcaaagtatgttataatttaatatctgcgacattttgatttgtacttatttatttttattgtattattaagaactagtattcttcccccattaaccccacccctttttttcttcatttctattgtttgaacttcattgtttttatttgcctataagcggtgattgtgatcgtatcagataaagtctgttacagttataataataataataactttaaaaaaaattgtttattttttttaaatagtcaaaaggtgaaaagaatataaaatctgattaaaattagaagttattttgaacagtttttcattatttttttttttgtttttataaaattatttttatgattgtgaataaatataaattagccttttttaagataaaaaatcttaatatttactagattattttaccttgggatcattttttaagcggtaaatagactagttatatcatgcaagtgatgatgaataagcattattaaataataaccatactgatttgggaaactagttaaactcttagcgaccatttgttgtattaataatttaatatgttcacacttttacgagagagtttattgattattttaatatatctattatctacaatgcctgtgttgtgctgatacccgaggaagataatatttcaactgaaaactcaagatagttgaggctttcagtagcttagtaggacaggtattaggtgattgatgagaatacaagaataaatttgactagacatttaaaatatattgttaatattaaatttaattataatgattttaaccaattatgtataattataagattaacacttttcatttcctatcatttcattaaaatgccactatgtcatgctagttgtatatcatcttttgcgtttattggtaagtcacttttaagttcggttgtcttggttaaatcatgctagcagttgataggtaagtgtcaccaagaaacacgacatttccttctatacctggttatccagaaaaaaaaaatgcccggtttctatgttttagtttattttatcttttgaataagttctctgttttattttcagatgatattgttttataataattacaaaataatgttattctgattaaaattaatatcaccaaaagttatgaatcgccatgcatgctcgctgctacgtaaaacacaaatttggcagcctctcatgtctcatttatgatttatccaataatgtatgggattttagttctgtaataaaggtttaatgttactttttgatcaattatgttttggagttgttctgttttaatacattaaattttaaaagtttaattttagtcctttatatttttaaaatgtataattttgatcattttttttcattttttcgttaaaaatgttattgttatgttaatttttaaattttaaaatggtttaatgtcattttgggtctattatggtacattatgttttaaaagcttcattttaatcttttatgttttcaaaatgtatcgctttggtctttttttcaagtttttttgttagaaacttagtgagtcatattttaaattttagaatagttaagttaatatagtgataactaaaaatcgttactatcttttttatttaaaaattaaaaatcaataaataaagaaaaaatggatctgaaaccacgaataacaacatcaatcaatctcatattgttattaatattattctcttcattcaatttaatcatttaataatgataacaatttcattcaccaattattctcaatcacaatggaaaagagctcattctccttccgccgcttcgtctctcgcccttgttgccctctttattgcaacctccctacatggttggaatattcagtggttccaatgagattatatatttacgttgttcagtcagtgtagtgttgcattttttatcttttcagatcagaaaaaagttaaaggagatgattattttttagttgtttatttttaaaaataaaataatgatagtagcaatttttagtcatcactatgtaaaaattattattttaaaaggtttaatgtcagttttggtccaatatattttgtagttgtttcgattcgaaacattaagttttaaaagtttcattttaattctttatatttttgaaatatatcattttagtctttttaaaatttaaatgttaatagaattctaacctttctatcataatattgaaaaattatcaaaatcatacatttcaaaaatataaaaaaccataatgaaaattttataacttaatatattaaaagaaaacaattgtaaaatataatgggctaaaattcacattaagcctaatatttataaagtagcatgcataatacatctttcaatgactatcgctccttgcaacaatgttcacacgtaccacgcatctttcaatgtatctttcacagcctctatgatagttcaattcataaagtaattaaataccacgacgactaaaattgaatttgatttaaagtgagatatttgttgtaagttgcatttggcataaatgagtgttgagcttgagctttgctctggtctgaagcttcatctttattaatggtttagttggtggttgagcacctgtcttggtcgcaccgaccttacgccctccctctctttttgttttttgcgtacaaatacaaaatctgaaaagcattaaacatttccaaattatggaaaggacactcatcatactaaaacaaataatttttcatttgtcagatattacttctttcgttctatattatatgatgttttaataaaaaattgtttcaaaatacatatcgttttacaaaactaatatatcattgaatgttttttttaacactactcttaatcaatatttagtgagagtagtgtataataagagtaaatgagtaattaattagaaaaataaatgatatattaagaaattatctaatattttctaaaaaaattaacaaataaataacatttcttaattattgtatcaaaaccttgaacatcatgcaaaagtgtagcaaaggaagtattaaaaagatgaataataacgagtgtctaagaacataaaatagaaattttttattgggatgtgaaattaatactccaacctaatttcaaatgctaaccggtgccttggaacatatttgtaaagagttacatagttttttcacttcaattatatactgttgcgaaagtcttaggatcgagcaaccaacggattgcatgattgggttgttctccaatgcgtctgcttcacttttacgtgtgttgatccctgaattattggccacttcacacgtattttttgaaaccacacagtttgctattgtcataactatagacattgcgtattcattcaagatacttcaaataatatttagttgaacttccgatcatactaagacaaggtgatgataaaaagtttttggaaaatagtactaagttatttaagattattgaattttctagtatctatctgaattataagttgatggtgtctagggtggaccacttttgtaagtggtctattatgtaccataatttataaccattagatttagctaaagtgtaaaatgttatcatagattttctctatcgaatcatctccttcttcccttcctacattacctccttttttcatggctatcgctgccatcacgctccatcatagtcgaatctccttatatcatcggtcaacgacttcctttaaagatataaattgtggtgcatgatggaccatttataaaagtgatccaccctagacatcatcttataagttagtataagttataactagagtgattttcaactaaggaattaacagtttacattaactccatgtttaaattaaattgatataaattagagttaatatgtatgtactaatagtataaaatagttttacactgttatctaattacacatttccgtttgaattactttaagataattattttaaaaattaacaaatttatcatacattgtgagttatgattgaatgactgtgtaaaattttggtttaaatgcaattttggtttccttattttgttcaatatataatattggtttcttcattttaaaattgagacatttagttctcttattttaaaaaattcataattttagtcaaatcttcaactttgtctacgttaacttcttttattttggtctaattgaattctagacctaatatattcatttaaaataccatcaaaaaataatttaattaatcggattgtaagaaataaaagtagaaaaaaattaaatattaaactaaaattaatagacaaatcaaaattactaattgtgtaaaatagttagaagaaaattatatttaaacctacaatttttcacagcctcaaagcataattttttctctataaatgactctttcttttcaagttcaacgcaactctttgttgtattaacacctatgtttattttgaagtgtcactcacctaactagtcacctatctaccaactgaaaaccagttcctctttctctgtctttattgaattcaaattatcaaacaaaaagtcaatgaccttttccttccctttgttcctactcttcttcttcatctaccccctccacttcctaccccttcctagttaattcctctttccattttctccaatttctggggtttcctcaactcttttcctttttccaggtctgtctgcttcttccaattctctattttctttcctcttaaaggaacttgcccaccaaagtctcaaattcaaataggaaaaaaaatagaattttctttttctgcactcttcattgagtatgattgttttccattgagtgcctttttgctttaagtttatttatttatttatttttatggagcttggtttcaagtttctacagtgagttccctttttgtttttctagtcaattgtgttcagcagcaatttgaaatcccaaaggcacaatttatctttatgatcttaaaagggttacattttctcatttgatacaatgcttccagataaaaaaaaggctttgatttgatgttgagatgagatactcagaacagaacaagcaatttttttatgaccttatggctgatgaattatatgtgattgatcacttttttgactggctatccttatttgagttggtggacaatgggggaatgaaaatcacttcacacatgctttaatcaacacaaatgcggaaaggttgtaagtggaatgcaactcctttacattccaaccacaaatcctggccctattacagcacgaaagcaagttggaagttattttttgccccctacaaagcaacaaggagttcaggattgaaaattaaaacatttctaactccatttcacttccctcctcattttccatttgctcagacaatgtgagcaaacattgtctgtgtatgtttggattcacgttggatgaactagaatctcgttgaaatagtagctaacatgattttaagtgtccactttttcatacaagcattgtctatgcatgtttgaattaacattggaccatctagaattacgttgaaataccagctaacatgattttaagtaaattatcccgtgtttgatttcttgttgagattggatctagaattaattttgagttgaaacaattttacatagcttttaagttgaatcgagaatttatattgagttttactactagtatgcttttatattaaaaacatctaaacataaatcaaatcacttcaaaatcaattatgtaaatgttcacccaaactcactgaaatcaattgcaactaattatgattcttctttcactgttttttatatgacttggcatcatctgtggaaaatgaaatttataaaaggcaactaatttatcttgcaattttaacacaagagtataacctcccattgaatatcattatgtgaagataaatagaagcatgatgtgcagatgaaaataggcctctcatttgatgcacagtacttactctctcacatcttttgctagctccctttaacccaaccaattcgccatgtcaagtttggaggaaccacttggtcttgacaatttaccaagcatgaataccattgataggattcagaggttctcgtttggttcttgccgtcctagagtagataacttgggcatgggaaactgctggattgaaggacgaagttgcagcacatctaatagctgcaagtgagtcaagtattgcaacttaagttagagacttgatacactttattgatctatcattcaaattcaacctcctttttccctcttttatgttctaatcactgttgttgtatagtttttaatctgttacctcctactatgtccgtaatatctttctatctctgtgcagtgaagatgatgacgagtattcagcagagacatttccatggaaaagacaaacaagagacttatcccgagacgactccttcagtcaaaagtctctgaccaaagggaggaagtcaatgaaatttggaatgattgatgattcattctctgattgccaaagcagtccaaaatgccataccaaagatttgcaaggtttggattataaggtaattcagtggctgcataatcttcaatactctgttcaagttttttcagctactaacttagctatctacaccttgcctcgtgtttccaattaagtaatatattttaaactttctattgtctgtttattttatcacatttctttgtctagtaattagcatgttttcaatttttaattggacaatggctatgatgcagtttctgaatagtataccaaagtttgtaaagatagtagaagttggtccaagggatggattacaaaatgagaagaacattgtgcctacatctgtgaagattgaattgattcatagactagcttccaccgggttatctgttattgaggctacaagctttgtatctcccaaatgggtcgcacaggtattataatggctttaccttatttgttgtaacttgacattgatgatttttaagtgatgggtagagtaaaatttctccaagttgcttgtatctgacattagttctcaatctcatggatcaactggtgtttactatggatgcttttgaatggctactatcattggataaaatccaatccatttatagaattctgaatgacttcaacaattgttatccctatgcattccatctgattttaaataataatgtttctttgtcttatagttggctgatgcaaaggatgtaatgcaagcagtacatgacttgagaggcatcagattaccagttctgacccctaatttaaaggtagaataatctagataaccataaataggcagtcatacattcagatctctgacctgttacattattagggttttgaagctgcaatggctgctggtgccagagaagttgctatttttgcatcagcttctgaatcgttttcaaaatcaaacattaactgtagcatcgaagagagccttattcgtttccgagctgttactcgtgctgctaaacaactctcaattcctgttcgagggtacgccttttattttctttttaattattttaagattacatcaaataactgtctgcttcaatatctgtattgggaaagcaatacctttcacaaagtggccaggtcaaggtctagtagttggatgcatgaaagtcccaacgattgatgttgttaattttactgacacactattctgtttctattccataggtatgtatcatgtgttgctggatgcccagtggaaggaccaatccctccctcaaaagtggcatatgttgctaaagagttatatgatatgggttgctttgaaatctcccttggttacacaattggagttggcacaccaggtaacaaatttgatgaattttgaacttctaaagtttaagtgatccatgcttgatacaataattgtggtggtggatttgtttcattctgttggtagacaagattctctattcttgtagaccttttgaagtatgaactttataaggtgaaaatgccaattcttggcagaacttggggatgaatgtaaaactaagtgctttgcattttactatttgtcattggtttctggcatatgatccttgtacttagattgtttcccattcattttgtggtgttcaggaactgtagttcctatgcttttggctgtgatggctgtagttccaatagataagatagctgtccactttcatgacacatatgggcaatcccttccaaatatacttgtgtccctccaagtaagtcatcaactaaatagcttggacttttgacatacttgtgtgttttgttttggcactcaacaatcattaagggatgttaatttgtatttgaacagatggggattagcacagtggattcctctgttgctggtcttggtgggtgtccatatgctaagggagcttcaggaaatgttgcaactgaagatgttgtttacatgttgaacggccttggtgtcaaaaccaatgttgatcttgaaaaactcatgttggctggggatttcatcagcaaccatttggggaggccatccacttcaaagactgccattgccttgaaccgtgtcacaagtaatgcatccaagatatcatattaactattaagtttaccataaaaatttatatcaatatggcaatatgcttcaagtggtgacatatgatcactctacatattatgttcctagttctgcatgctagtaacagaggaataacatgttcactctcatggatgagttttggttttgggaaggaagaaagatagcgagtgcaagttgcttatttgaagcttggcttatcattgtacaacaaaagtttttttttcttgcccgggaatcaagaatcgtgaattgtaaagataagcaaaatttatttaattagtcataatatttttggaaacatatctaagtttcatggaaataataaagtaacgtgatatttttaccagtgtgattatttaccacattaaataatctaatgagagtaatctaatatttgtatcgcaataaaaaactttcagaaagttagatttcacctcctcatgagaataattttgtggaaaaccaaaaacctagctaaaaaaaattcccagaaaacattctttcttggaatgctatttttaaaatagatatggaaaactaagattcttaattaaagattttcaaaaaactaaaattatctctaccaaatgaccctaaactgttactctccttcacaacttctttgcttagaatatatttaatgatttcatgatttgattgttgtatttggtgtttgttggagtgttaattataacttagttgggatcgcttcaactagtttaaccttgctagctccttttttcccaaaagaatgtttataatacataagtttaatttagcattgggaaataacaaggaaaaatcgtgggaatctaatggaaatgagaaaattttacatgatatgtaaagtttcgttataataattattttaaaagttttattaatatgattttaattgataaatttttttttatactcgcagtatatagaaattaatctcaaataaaatttcaacacgggttcttttaattactagttataaaggaattcaaaatattttcttatcaaaacaagttactgaagaattgaacccgaaaatattttcaacttagaacaaaattctttctcgtgaaaagttcttgtaattttgattaaaaaaatgtaacaagaaaactcttatggattgctatttattatttattttatgtattttttctttttagttttggttttagtttttcataaattatttttgttgattttttttttagaaatttatttattttttaaacaatatctattattattatttagtgatgattttaaatacattttaaaatactatatcaacaaccacagacttttaaactttataacaaacaaaaatataaattgaaagactaaaataaaacgcacgatatatgcaagagagtaacaaatagtagtattaaatctatctttttcataaattttacccaatcaagtgcatgactatgggtgtgttttgaacaatattctaatatataatcaacaaactcatttttctgggttgagattttgaacacaaaatggaaggacttgttgaaagtaattaaaagatttaataaaaataaaataactttccacagcctggaatagaatcaagaaattcaatatcagaattttccaaggtttgctactgcggatgttagaacttgcaaaatttatatatatgcaatgtgctaaccaaagttgatgccaggattaacaaattgattaattatgtttttgtccttatatatttttaattttgtttttaatctctaaataaaatattttgtgtttttcttcttatacttttcctttattaattcacataacaatgttttttgatgatgtaacataatttgtcacatcatcagagtttaacaaaataattatatgtaactttttagtaaattatatttttaattattaactagtctgacatcatcagcagatatctaaacaaatgaaagattaaaaatataatttatcaaaatattatgtatgattatcctattaaatttttttattacttaacaaattactaagttgttaatgtggatgttacttcattaaaaatcagttttgtgtgatagtagagactaaaaatgtttaacagaaaaaaatatatgtttaacagaaaatagtatagggatcaaaattgctaaaaatttgtttagagactattattattattattattattattattattattattattattattattattattattattgattaattgtagttgaaaatcacaaactattgaactcaaacaacaatccaaaattcgagatattgtgataataacattgtcttttagaactgatccatgtgatatataagtctcgtaagatatgataggtcattttccgtgtaaactaagataacaaaactaaaaagatagaattcaaagagccattgaattcaagttgagagatgtgttaaagaattaggttaaccataaaagggtttttcatatgatgtttaattaaaattggatatataataatagtatagatattaattaataatagtatagatattaatttctggaataaaaatatgaactaatatgagactgaaaccttttgaaatattctcaaaatacaaaacactcaacacaagaattgaataggaaattttatggtattttgagtattaatatcaaaagggtgtgactctatggcacatgtacaaatcgtgtattaatgtaatgcttatgattttttaattcactgtcataactatagggctttgaagagttctcatcccaacaaatcttaagtttcttagggaaaatgttgaaggagagaaaggaatggaggattgaaggaaaccaaaaggaaattaactagatgagaaaaaaacgaatacgaggatatggaatttcaatccttatcctagttttggaattattattgaaagaaccttaaatttggtattttcgttgcttacaatattttctttctaatgtctttctcgagggaaacaaacaataacttgatgtctgtgtttgtttaaatttaaggttattgagacaaaaatgttctgacttgaatccccttcaatatgcagtagtatgcaacccacatacaaagattctggtcccaactaccaagcatgcctttgctgaaaattgtttcccaagacgggagacatgtgatgccctcaccctagcatcatagcagtgtcttcttggtcaccaaatgtgattctaaacatgtaatataattcatagatcatctaaaaattatgttaagttaggcatttgtgtgattttagataaatgcttacgtgattgatcttaggttgaaaagttgattatgaatctaaaattgtttttgaattgaaacaattttaagttgaatttagaattttagtagtaacttgcttttagaatataaaaatttaaatttaagtcatttcacttcaattttgtataatgaatttcattcaaaatgatatttgtaaacattggccaaaattatgcatatacataatctttgatattaacactatatttcatttcagcttatattgcgtgttaatgatcacccatgacaattagcatttttagccatgcatcatgtttggaagaattcaaggaaaaaacgtgcaagctataaatgagagcttccatctggatattaaaaaaaaaacatgttgatgatgcaataccaaatacacacatttagacttgtcagagcaattaaaaaaaaactgaaagttcaaaacagttttccgcagcgggattcgatcccggtaattcaactctaagaactagaattatctgtgtgctactgcagaagttgtaacatttattgcaaagtacattataaatattcattttgaacagtatagcaaattaaataagcagtccatttcgtcccaaaagaattacttaatctaatttggcctttgaataaaaagttactaaatattcttccaatacaacaaatacgagataatagttctatttttctttttaatatgaaattaatccttaaaatagtgaagaatatatcaattctataataaaatcatgacacaaattgatcctataaaatattaactcgaataaaaaaaaaaaactaaagtgtatcacctttatggtccgcgccttttctgttttcttctattcttctgtgtatatatagcccatgtttatttttcttttaagaaaaataattattttttaaagctctttaaaaaataattttttcggtaacttcaagctaggtaagttaaattttacaagagcaccagaaacatttaccccagtttaatttgtgggcatgctggtcaagaaattttgtctttcataggtgttggtctttttggaataccaatttactttgtgtcattgtgtgatcatgtgcttgctagctcgtggcaacactcataggaggattcatcctcctacgtatcatgcgaaatcctctaataataacaaaaatggcaatggcatgttaaacaccccaaatgccatcatggacttgtgcttacaaagttttctatatttaccatgcatgttacacagattatctgtataacactcccaaaacttaattatggcattatcaaagacaaagctaattcatcatgatgagggacacccaccactctcaaagttgaacttaagaaagggagctaaaatgatcatcttctggtcgtgttaagtaagccttgacttcttttttctcattaaaaggaaaaaaatcatacaaatttgttgagtacattagactatcattaaggcaaggaaataaattggtgcacaagcaaaatcaaataattataagacctcttttttactttgcttttggttcccttttttaccggtcaaagtctcgtggctcccctctaccataattgggatctcaaatgcttctacttagaataagtgacatggtttcataattggtcatggctcctagaatgaatttatctctagctaactagcttcaggtaaatttcttaaatagttagggatgcatggggccttaatttattgttgctataatcctattgttggttccatacgacattagcagtgattgaatagtaattctactcatatgagcgtgtagctgtacccaagctagttcaacttccatacttttcactttcgaatgcacatagatatgattcacttccgtttgggttgatcacacctgttagactatcttgtagtttttaactcaaacagtgtctacgtctcaaaatatattgaaatctttttaaggtaagctatgtaatgcttaatcattgaatcttgaattctttatttaaaaccaaaatactgagaatatgttacaattataattagttaccatgctaatatcactttcacctttgataatccattctaataacttatcaactatttcaaacaaatatttattttcatccatctgttacttttaactggcttaagaaaataagatagcttataaattattagcttataacaaaataagctactttaaccataaattctattatggtgattaattacttcagggttttcatcgggttatttcaagatctcaccctaaagagtcaaagactcaaataaagtaattagaaaactacataaattctagtgaatcataacttaaagtatgtttgtgtctatttcttggaatgtgaagtaggagcaggaaaggaatgacctgtctccagcttgttcatcgattcccattttccgatagtgattacagaaattcatgtttagatcctagtgaaatactaaaaaccatgctatcacattcaactaaaataaaacaaaaagacaaaagcttgtaatctacaaagtagattttccaatatattttgtcaagtttttattgtcataaagccaaggggccatccaccatgggagtaaaacaaattaaaaaaatgttcacaaccaaaagccaagaactttaatttccccttttctaaagccagtaaaaacaacatcattctttgtaagaaaaagattcatgagctcgttattaacatttccatggcttatttgtcaaaccccccaccagtttgaccaaattattatttttccactgttcaggctgaaataaataaaaataaaaaaggcttgaatcccgacagattttttgtaaaagtacacagagatcttatgacctttgaatcatacaatatgctagaataagactaaatagcaagatcaaaaaattgtgaaattgcaagattcaaaattaacgttagtatttctagatttcttccgtgcaaaagaattactctttcaaaacctaaaatctagtgtagcatttgatcatccttcaaatatgctcaactagaacacaacctttttgtaaatttgttgtttgcagtcgcatatgaaccctagctaattgattttggtttaatggttaaaatcctatttctccggcacttttggttgattactggattccaccccacttgaaaatttactcttgatagattactgaaagtatatggagctaaggcacacggagacacaattaattaaaattaaagcaagttgagaatacaaaccaatgatgttgagtgccacgtattatatagttcattaatggctctttctacatattttcatgttttactggatatttttaggttaaactgtactctagcctgcctactatacatcgtcaaaattcaaattaggtctcctttttttttttttcaaatttaatcttctactattttaattatataattttagtttgtgttaacttaacatttgatgtgtaataaaaatattgacatgatgttttattgtattatatatgatgtgaacacattcatgttgatgtgatattctattgtatttttatgttaatattaaacctcaagttaaatatgaagcaaaagtatatgattataataatggaataatcaaattgatgaagaaaatagacgggtgaaattggaattttgatagtgggaaaacttaaaaggtgtaattaagtctactttttataatacaagttatatgataatgttatgaaggttaacaaaattttattcaatttcttctttaatagcctatatttgagtttgtggataattgtgttatagaagttaaaagaaaaacaatttacggataggatttattatattttttgaactataaaaattgaaattatttataaaaaatttataataacttatacattccatttgatcaattttttttagtgatataatttatttgatgaactgacatagacagatacacaattatattgaagttcaagacctctctctctcatgcagtgatcacacaggaacatcacctaagcaatctccaacagaagcagcaaaggctctctcttctgtctctctctggtccatagttgtttcccaagtagtaattaaaaaggcatccaaacacattctgcaccatatttatttgcattgaggcaccaacccctatgcacagtcattgactctactcattttcagagctcacacttcaaggttactcacactatcgaattcaaaataatccaatccgcatacaagtttgccaaaatcacaccctgaccaaaaaggaccaccacatcagaccatcacatcacaccctcctccaaatcaactagtagtatcactttacttcccttcctctaagctttattattttttgtttctaagtatttttagtgacaccctttttgaatcagatccaaaagaagctactagtttaatctgtttctttctttatgggggtttgagccaattatataagttttccatgcacgatctgtgcctagttgagagcatgaggctgatgagtcaggcttgtttctcaattctactgttgattctgttcttgttcaaaatcccatcatctactgctaatgggtatgcaaaatctcaaagctttagaactgagcctttgtcaaatcttagcccctttaaaggaaaatcacgacagaacacaggtgaaggtggtagtgaagcagttcttggtgatgagaaaaggataatctacactggtcctaatcctttgcataacagataagtggaaatttatagttctgaaggatctttttttgccttgtttatttcaagctctctctgtaatctgtgtatatataattttgtttcttttttgagttttttacttctttacatgttctttctcccatttcttttcttgtgaaagtttgtgacatattttcatggaccagtttcttctggtgtattgtcaataaccgtatgtaagaatgtaagttatgttacaacgaaacatctcaaagaaaataattttggctaacgtgtttccaattccataatgtttttggaataaaatttaacttttatgtatagacagtggaaatgtttttttcatttttgttctgtctaagtaaattagaaataaattttaatccattgacagtgtagacactttttaattataagtgcatgtactatttttttactctttggaacaagggccaaataaagacaggaaatgcaatgatgcatcatggatcatttggctggcattaatggagctgttgtggtgtagtgactgtttaatgtttaacagcttatgttagtgtatgcctttttttgtttttatatttccatgcaaggagaataaagtacgcagacaactcctgctatatcttttacacctttgttcatataactatagtttatggttagttaattagtttaaatatattgttaatatgatacgattcttgttcatccaagtaggtaagaaattagacacaattctctcatcttttttagtcaattttgctttggattttgggtgcacctgaagttcagaatacagagatttattaaaaaaataaaataaaataaaattgaatatcatgttcatttaaaacagacaaaactcgaacctgaaattcagatgagaacttttccggtcgggagttgaacgcgggattcataattgaatttaaccaatgggccactacagacattttaatattttgatgcaaacatttttttatatataagatttttttaaaaataataaaaataaaatatgataatttaaaaaaaatattccgcaaggagagttaaagccggaattcatcaattgaatttaatcaggtgtgctactacagacgctttgatattttaatgcaaacgtttaatataataaaaataaaatatgataatttaaaaaatattccacagccgggagttaaaaaatatgataattttgatcatcaattaaatctaaacaagcgtgtaaaagaaatctaaatcagttgattaagtaaaagtatgagttatagtatatttgtatgatattgttttttattcttacggatcaaaacacctaatcatccgaagactactttcaaatggactgaaacggtgcaaggcattcttaaggaaaaattcgatgcatctatggttcttgttgaggatgaattctaatacagtagttaagttgtgtattaatgacttgttgattatatattagaattaaaaaataatctctttatatatataaaagtaaaattgtatataatatctcttcttttatctgttaatagtgtgaagtgtgtatacaatggagtgcgtaattttttatttttttatctatgattcttgttctggcagcttctactatgcttctccccacctgccacgatattcattttgctgaagccttggcctacaggtgggccattgaattatctgcggatcttatgtttagcaacgttcagtatgagagtaattgcatgcccctagccaacactttctttccctattaatagctattttgatggttttgtgttgggattgtgctattttgcgtagaagcacatccactcattatttatctcttgtaaaataggcaggctaatagggttgctgaaactttggctaggctatcctttttgtttaatgagttccattgcattgaggagacccctccccaaattgtggatattgttcttgatcatgtattgactcaaggctttttctgtttcttaatatatacatctgacttaaaaaataaaaaaaaaaaactttgtataatacttcttattttttaatgataattattgaatatattttgtatttttatttaatttattttctttgtatgatgactaataaaatgtgttttatatttgcatcaaaggtatttatttcattttaatagtttttataaaataatagaatttattcatttttttataaaactattccgtagcaagaagttgaacccgaaattcatctttggaatttaactaggtgtgctacttctgatgttatgataatagaatgtagacaaatgtatgtatgacattggtttttgtttttttattgttaatgcagtaggttattaagactaagtttataaggttttttcaggagtttataagcttttttaattaatttaaattttttgataagttacttaaagtaatttataaaaaaataagctagtttataagttattaattttttcttctcatttttatacttagtattttgtttaaaatttcattttatccttttatttaatttaaaatttaaaaattaaaaactctctatcttatctttttttcactgtcggaaaaaactcattcattttaatgtcaaattatttattttaatgaattattacattgttttttatttatagctaaaatatttggttactaaatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggactccattatatagcaataaaattccaacaaaaagggattaaataatattatgttcctgttgtacagataaaaaaaatgtttaagaaaaaatataattttttttaatttttgttttaaaataatattattataaagtatttaaatgttacaaaaataatttaaaacaatgtaattctaacaaagttaatttaatttaattttaattttccaaaaaaatggaaaaaaaataattttaccattttttataagacaaaattttaaaaattattttcctacttttaagatgataaattattagaaataaaatttaaatattaaaaatattaaattatcagttaactttatcaaatatttttaattaaatcggctaaaagttttgagttaacttttagctttttaactctagcttatagtttataagctgaaagcttacaaactagttttattaaacattaaaaaaaatcataaagttccaactaaagcaaataattttgaatgttctactctgcggaaaataataagttaatagtttttttgaagtttgttcattttcttttccagcgaaaatttgaagccaaccaattttccgaaactagctagacagttttatgtagatttgtcaaaaataataatatatactctaatttattaattaaaattaatttaatgatatttagttaaataaattaatttgtatataatcaaatacataagaagaaatagtattataataggagaggaaagagtaatttatttttatttaaaagtagagatttgtgtaaaaaaatataaatattaacacttgaaatatacagttacaattttaatttaattaaactataacgagctactatttataaggaacttttatatttttaagacttttaatattgtagctccttttaaattttcaaatattaattactcttatgtgctagtgtgatttgggtgacattgtaattcaccacaaggaccttaacctctaattgggcctttgggaccccagcctccctagtttctagttcggctcaagatataatccttgcattttttttcatgtctcaaatggtcagatttgcctttttttaataataaaaaaaagaaagtcagattttcctttttcaagatttagttcatattaatattttcaatccttacgtaagaaaaaaaaaacattttcaaaatctaaccatcttcattttaacttcaaacttaaaaatctccgcactgcaaatatctccacaacatttattgaattaaagtttgtttagataaatttctctaaaaatatttttagaagaaaaaaataagaagaaaaaaatgagattaacttttttttaaagtaaaaataagttttccattaactaatttttagaaagttcaccaatataatttctctaaaagatgatatgacatatataaattagttaataaataactcattttaacttatagagaaactcatttcatttttttcttcttttaaaaataattctaaaaaatttacatctaaataaatccttaatcatcttacctttttttcacgacaagatctttaaaaattacataaataatggacaaaatacacctttatagaaattagtaaagtacattaagcataattttacagtaaactatatcacacataattttctacaaataaatctgaccatggggatagagaacacatcaaatcttatagaattttcttatgttgataccgatacttaaaaaatacaaatagaccacgtcagttactttccttttaagatttttatgtaggaaccaaaaaaacttacttaattttctctttcctcaaatagtgataaagttgtccattttatctttttacaattttatcccacaataaatatataaatattaatacttaaaaaggaacaaaaatactcttatcatataactgcatagttgtgtgattcaacattttgctaacattttttatatatataaaacgagctaaatgttggcttctaaagacataaatataattcacctctcaattcgcccaatttgtgttttcatccaatgttgaaaactaaatcagttatctgtcgtgttcatacttcaatttagttgttgtggttctctaatttctttctctaacgatagatgcatatgacttgttgcttgactttttggtctccacaatccactatcataaacattgctagttctctggattttgggtttgctgtgtgcaaactctggcgttttgtgagggtatttgaggtctcaagtaaaaagctacacgggattccttaaatattgtacactgtacaatatatatttaaaaatttaaattttattttttaactccaaaaggtctattaaaaaaataatctaaaattaagcaattcttcatcttcatcatccatagattaagattagttatttattataattatgaaaatattatcattgtaatttattgcattgtagacattaatgaatgatgactaggttacttattttaatttttattctttatatcaatataagtatattttagaatttgtgggttttacgacgaaccatggtggcatgtctttaattccacttacaatagctaagaaactcaaaaaagttagaaataatgcgagatgtttaaaatattatgagtaatgatattcatacaattatatttataataagttatacaacaacaaccacattagcacaaaaaaaacaaattttaataaataaaaaaataaattccctatcttatctaacaggttagcaaaaagaaaatcaaatcttaatttaaaaaagaaacaaatccaacaaccaaaaaatatcgaatttgataaataaataaaaacaatctagtggaatctctcatggtaattttcattgaccgcctaatccttcccgcactcttgccccctccttcaatgatttatatctccttcatgcatttgtttaggcatccaccattaaaattcctttcatgttctgcaattcaagtatcgttaccttttcactgagagtttataattgaaactcacccaaaacacaaaaaacaactaaactacccacaccttaatggtgctagattgagtttttgtcacttccaatcttttatctcatctatgcatagtcccgacatatggagcaattcaattaagataggaaatttgtttttccttttactaaaatttgaattattgctgatgtggtaattgttgtataatttgttgtaaatataattgtataaatatcattactcaaataatatttatattttttaaagaaagtactaatccaacttaaaaggttttaatcatggatgaatgtacgaacaagtctgatccgtttaagattcgtgaaatatgtgttttagatgtgctggataagtttgatttacaaaataaatgattttttttttaagatatgtattctacttgcaaaaatccgtgaataaatggattgatttgcgaatctaaatattaattgaaaaaaatattttttataaaaatatttttagaaagtgaaaaatgtataaaataaaaaaaaattattttatttttaagataaaatctatcatactaaaatatacaaacattttaaacataacaaaataacaataataacctaaattaaagaaatcaaaatcttaacataacaaattaattaatattattttgacgttaaatttagtctagttcatgagttcacaaataaagcccgataacacgtcagactcaaaagttcaataatattatacaaacttaaaaaaatggttatccgcccaatccgtgaacctaagtctatatatgcaccctagttttaactacttaaactctcctctactctacaatttaaattttaagtcacagtattgaaatagtttaactttgttgttggtctattaatatacttctcctttctggtaaataatatagaatttgttgcacgtaaatttacgtcctacaattttatcttacgcctaagagccaaaattgcattatgtatttcttacaaatttgaaataccacgtacgcctaatcaaagtgcctgcgatgacgctggtaacagaatttattgggatataggcctattcaagagtccagactcctaaggagggtcaatgggtaatggcaccattaatatttatttcctcttgtggcctgtggcaatatagatatctactatgtcacgggtaagaggaccttgaccaaatatgcattaaatttgtttaactaaattgattctccatgacttaaagtaaacattatgctacttcttcttacccagtttgtaagaggagaacaaatattattatgttactccgtatgaaattgagtttggatttttttataaagtctcaaatttgagattaaaaataaaaagttaagaaaagtgactcgatgattatataaattaatcatcaataaaattgataaatatttcacccgcatgtaaaaagaaatataaattttatgagatgctgaatgtgatcgtttggtatacgtttcaatgatacctaaaagggagagaatatcacaagataaattatacgcttggtacgtaatgatgcaaaattgttattaagaaatcataagataacaatagggtcacgataaacagcaaaacatagtgaattaagttgcttagaataaacattaacttcctttgacatttatgaaatgcagcattaataaggccaacacagaaagggacagaacaccataaaaaccctcacaaaagctatccattcaattctggtagacctatgaactttgaagattactttgagggatgacaacaaagttgctcaaatatatataatccaaatcccttcattttaggaacaacaatccctacgctacagctgtttcccaagctctctatcattgtcttgtctttttaacaaaaacactacaccttgtgttatgtcattgcattataagtctcttaagtttagttttctgtgtcaaacatggtggatatgatggatatctctttctccaacgaattctgctacatgagtgcatgtagtttcagccaagagatgtgcttctacagtgcaccaactagtcctagcaggctcaaactaagagcaccctttggttctcaaactggccccacaacaccaagagcagcaacacatgaggatgatgcaaactccaatgtggatgagtttgaatttgaaactagtcgcaggttcaatgttagtgtcggtgacttggacaccgagacaaaccaaaaggatgagaacccttttggtgattcattgcagactatggtatttgctgatgagctattctgtgatggtaaagtcttaccactgatgccacctctcaaacttcctccaaggatgcatcagaatggagatggtagcattatgagcactcacagctcaacactgacgtctccaaggtccccaggatcggtgcttaggcttcggttttcgcggcaaagtttgtggaatgatgactttgatcccttcatggtggctttggagaaggtcagagaagaaaagagagggaatccaagtgcaagacatggtctcaggaggactagatcactttctccattcaggagcttcaacaagaagtctgaaaaaaatgtgggaatatcaaagtcaagtcaacttgagtcacattgttgtgacacagctcagctagtatgtgaacttaagaaagagccattaaagcaagtgtcaggaagaataaatgtgctatcagagcccaaagggttgatgtttgcaaaacaggtgagactagtgggagggagcaatgatactactaccttggagaggacctcagtttccaaagttgctatggaaacaaagaaagatgaggggaaaagaggtggtttttggagaaggaataagaagagagaaaatataaagaagtttctctttgggactagtaacatgtggaaagccaatgctcatcacaagttagaagataaaatggcagcacaggagaaacaacccttggtgaggaaacttgacatgaaatctgtgaaagcaacagaatcaacacaatgggataaagatccaagaacaggtgagttgaccaaaatgagattggtatgtcacaggccattgccaagattttttctctgcttgggttatgaggaagggaaataggtagaatgtagaagttagctgaaatgaatgctttaaattacaattttaaattctattagtgttgctgtgatgttgcctctactttaccattttatactatctagtgggaaccatatgataccaatgctttttagaaattggttatttataccttgtctagaaattttcccacatgaattggcatataaatttccctaacaatcttcattccctttatagtcctttttttcttcttgcacataacgattgttgaatagacattcatttttctgggaaaataaaacactgaatggtagattaggtgaatcagcatgagcgctgcattctgaggaggctacagacctcaatcataaattattgccaaaagaaaaatcagttagcgcatagagagagcattttttagtcatattgctgatgatccgtttgcatataaacaatgcctgaaatacttcttacatcacttggtacgaaagttgtattgctgtgtgatttcaacgcttaataatctgagaaaatcagagattttaatcattctatatattgtggaatgaatgttctacgccatcagtgcataaatgagcaatttacattgattgaaattacaggctaaacttaaccatgaaaaaatgtgataataaaaaaggggaacgtaaataggtagcctcaaacgctcatttggtttgaatgatgagaatcctatacccctttgtctctaatgcagaagaacctgcctctgctaatgcttaataagaatactagtcttgatataatgctaagtagaaaattaaatctgattagtccaagacttcagaaggccaaatgcttttccaaatggaaatctcagtctcactcttaatctttctgattcctccataaaaaccatctgcttcatttccttcctctctatgatcttttctacttatagttgtcttactccaacgcgagtcaggagtgtactgattgaactctagcaccactgtgtctgcaaccaacaaacacataatgcagtgtcaaataaaccatgtttgaatcctaagaaaggaaatagaaatatacaaaagcctaatgccaagactagaaaaattgacatgttcagttttccatttggcagaatttataactattcaatattcgtggcaaaaagcttttgatggtatgactgcatggtccacaactccatagaaaaaatagacaggtaacatgtgtaaaaactgtcttcatgctgacacaaagtgatgaaaaaaatatgacaatagagttttgcacaaaaaaattccttttagaaagataacagccaaaagcaatgtgtaataatggccaggaagatactgaggcacaaattagtaatttgcattattattattctgttgctattgttatctatggttaaggaaatgttaaatgaaacatcagaccggatagctaagcagagattgtggattattctggtcataactactaatatcagaaaaaggaagtaaacttttaaggcttatagtgactgtggtatccccatattacataacaaaaagaaaacagaacataaaagagaaattgatgtttttctttccattttaacgtagttggccataaatgtatccactgagacacaaaatatcactgtgttggtggaatcatgacatgcggaccatgatatgtctaggggaccaatcatatatcatagctggtggtccaagttttgatatattatcaggaaaggaacctagcccaaattgtggtctggtctgccataaactttacatttatgtaacttttttcaccattaaacctccacaatgaaaaacataataatggtaaataacaaaactttaaaatatttaatccgttaaacagtatttcaaccttcactccaatcctgtgtcttcaaaattctggagcattttcttttatctctctccatttttgcatatttataaactattcagttgaatctaagaaaacataattcatccgaatcctccaatcattcgttcaatcatccctaaatcacatcctccttgcatctgtccactaagcaattttactcagaacataattcaacttgaagggaggaacaaaaatcattgattaaatgaatgataaaacataaaaggcaaaatctacagccaagaaaatataatgaatgataaaacacattcatttaaatggaaaatgcattaactcaccactactatgacaacggcagtaattttcattcccatcgcataactccaagtggcctacaacaccataccaccaacctgccataaaggtgcatttcatcaatctactatcacaaaaagggtagatggatgtaaaggaaaatgcacaattaagattggagaagtaattatttttatcagactcaagattggattccactttcctctttttgtttactccccacagtttgtattcatcctagtttttcttttaatgtccatagccactctttttttatgcttgtttaaatagctctttaacgatattctaaagaccataaaaaactgtaaaagtagaagaatatgttgagtaaaggaacaaaccataaggaaattctttgtttcttctccactgaatctctacatgatcacccggatgcaaatcatatagacaatcagagatatgaagatcatgtggaggagtatcaacaggtggttctcttagcctttcccatggaatgccatgctctactgcaactgcccttcttccatgtggtggatacctgtaataaacaattgatcaataataaggccactagatctatcctctttttcttccttatggaaactcttaaaatatattctctgtctgaattatttataataaaaaaatgatgataacactagctttgtaatcaattccttttgccatttctatttttcttttgaatcttcattactgctctagtcacgttttatttcttatggttaacaattatttaaaatgaaaaataaataaaaaatagtatgattaaaagcatagcatacaatcaagaaagaattgtgtatggtttaccatcaaagttaaaaaaaaaaaaaaattgttgcaattgttgttataagaatattcataaaaaaattaatttacctctgcgaattaaattttaacttttaaacaaataacatgaaatatatattctaattctggtgtgtgtatatgtatatacagaacatgtgtatggatgacagaactataatataatgaaaatgggttgagttaatttttaatatttcttctttcaatgactgatgggaacatacatataatcaccaagaatcatgtccaattaaattacctggcctggaaggtgtcagtgtgaggatcatagctaagttcagcatcatagcatgataatataaatccaacatggccattctgcagtgaaaaatgtaacttgtgagaaaacacaacaatcttctattctagttaccataaaaaactaatttgttttactattgaaggtatcatgatagaatataagttttcaatagcaaaaaccacaaagggattcataatcattgatacctcacggttatagacctgagcaggaaacctgaaattgccagtctccagagcaagataccaagtcatgagtgaatcaggaggcaaataactttgctgcttgatgctattatttgcatctaccttggttctcatccatgtaaaaggccaactaagggacacaagtctcaacaagctcctttgctttccatgtctaagagttccaacattccctttggaagcaacatgccatttccactccctataagcagcttgaccaataactctaccccatttctgtttcatgtgcctgtcccaaaggtgatcactcacacagctctctcttagggagcggcaaaccccggccatttgacaaagtgaagttgtagggagcttttcaagaatgcattctaacaccagctctggcaagtccaacactgacatatcttgggagtcctcaatattctccacctttgaagacttcttcattagagacattcttgtgggaatttgacaaagaaaaccaagccaaaggtggttcctaaacaacttagagatggacttcacagacaagtctttgtaaaacaaaggggagatcaacctcacttcacttgcccatgatgggagtggtttgagagataggagaggctttaaaaccagaaagaaggagatgcaagtgattaagtagagtagcattagcacttaggaagtaggatatattccacaggtcaagtttggcatatgtgataatagaaccttaaagccaattgtgcaacaccaatggctaacaaggggaaaagcaaaaccaaaatactttgacacaaattaatggcacaccctcccttccttgttggaaagaaacacaggaagcaaattggaaccttcaaaacaaaacaccttttaaagatgggttttttattggttcggtgaaagcccaccaaaacccaatggtaggcctcctaggccaaagttagatcagaataaattaggtatagaaccaatcgaatgaaccatgtaatgctaactctatctcctattggtttccaataaagaggagagaacaacacaaccgtgtagtcaatctaaacagctgtcattcaatgaagaatgaagaatctgtatacaatggtccttataaggaggggaatatcaacacagcaagaaatggaggtggggcaaccaagatctgataacaggttttataacaccgagaaatggaaaaaaagatggaagatgagtctatataataagaaccaaatatatgttcagaatctcaaaatcttattggtaagtggataaatcttctgggaatatatatatatatatataattggtgtgtagctagaataaaatagatctagctagttggaacttaagcagcaagaggcccacacaagaccctcaagatccacaaaaacaatggaaccaaggcaaaggtcaatctttggggtggtgcagaatagatagatagagaagaggattaaacagagattctgatgaagaagataatgaatgtgaagggtaggtgggacctcccctcactccaacaaattcttcaccacacctcaattattatcctctcctctgaaaatgcaatcacagaattctctctctttttttttttcttccttcttcctgttgttgttcttgttctgtgtgtggggcaatatagagaaaaattgatggacaatgaaaggaaagggcagagttatttatgaaaaatgaatgggaggctgaggttacgtaagatttttgtggatgtcaaacacatttcagactcttaacatatatccatgtcatcaccaatggctattgctctatcatgcaatcattcaaggattctcataagaaaattatatagataaataactttttttttttaccctaatattttgttgttacatattatttattgattttgttaataattaatttttatcaaaaactcttactgattatttttaataaaattcattttgttcaatcatattttttgcgtctaagtgagaagagaatcaaatctaatattaaacggatgaactacttaattgatatataaataaataaatagcaatgaattttaaaacttattttaaattattattatttttatctccagaaaatcttgtacgctttgtttttgttgtatcaagttctagttggagggaaatatgtctgactagaaaaggcaactacatcggataacgtatataggacaagattcgctaattttaatgttggaggttcgaggtaaggggatttggatccgctgcacctgcgtccactttaacaaacatgttatcgctgacaagtcacaacaagatttcaacattttaaacaattattatcccctctattccttttattttcaataattaaatatctgtcatgaatattaataagtataatcaattatattttattgaaatatttttctctatgataattttatctttcttgcatgtttaatataagaagtgatcaacttatttcaataataattcttttagaattatattttattttatcatttatttttttagattctataggataacattaatgatttattataattattaaatttaaaaaaatgatgagagtaaaaaataattttaaaagaattactttgtaagttaatccctcctgtttaatatataatatgaaaaaaattaagagtagactaagtttaatcaagttgtcaattcgttgacttttaaaaataaaaaagtcagcgattgggttcctgttaggccttaatttgactgaaggaagcatctagaaatagatttacacgtatagcaggaatgttagtatttttatgatgagttataatgcactatgcatgtgtatcattctaaaattatatgtttttagaatataaataaattaaatgttggtcatgatatcaaatttacttcgtcaatgcaagactcgatatcaaagtgataacaagagtttgaccagcatcttgattttttttttaaaaagttacaaaggtagttttacttttcattacttttttttttcttactagaattaaaattgttcgatggtacgaaactttttgatccattctttttttcgctctttaatttataatgaataaatagaaattagcaagttaaaagtttaatttgaaaaatcgagacattgaatacgaactaaaggattcattcatttatttttcatgtactcatgatgtgacatatatatatatatatatatatatatatatatgtctgtatcaaataatttaactaatgttaggtacgagtacatttaacctctagctaggggaacgaagaagctggagactgtgtattgtcaacatttccaggtctccaaactactggtagaatgttttgttttttttttcattcattattttgtaattatgattataaaatattccttttaattttattttttattatcaaatatatatatataggaaataattatttgcttcggttatataaataatgtataaaagtatttttttatttctatgctatttttaaataaattttgaaatgcaaacaaaataaagtaaagtaatatactagtttttttgttattaaaaataaaaacactctatctaatcaaaagctgaagaatccaactttttatctctaccttacagaaaataaaaggagtcacgtgcatgcggaggtgacaaataatggatcaccatttcacgtgtgtgtattctctcttgtattatagaattttagtaggagagagagagagagagaaaaaaaaacaaataacaaaaaattaacactttcatcactttctatgtgtctctctcttcttggaatctaagtattgcaaagaggaagtactcatttttttcttattaaattatgttattcattatatctacattttttttctctttctctctttaagtatatcatctagacatctagtattttgagtgtctacctattaccattttccaataatagagcaagggcaatgaagcctttaagaaaaaaagttcacgtgaaaaaaaagtaagacccttccttattcttaattaatcagattgataaaacgttcatttttttttatcagcaacattggcaaaacattcctagtagaaaataatgaataagaaatgagacaattaaattcttccgaattagggtttaaaacaatgtcttatttgacctgaggatattatataaacagaatcgaatttatcggtatttatttaaagcttataatgtacttttttggtcttattataattattatataagaaaaaaaaagtatttatctcaaaataattatcattttagtttttaaacataatattaattattttttccacttatattcttttatgatattaaaatgatatgggttataaaacaaaaaaaataataacaaggttaattttataaaaaaagaaatttatctatttattaatttttttatctatgtaaaataacttaaaataacaattataatgaaatggaagaagtaaaaataagtaaatttgtctgcaaataatttaattacgagacatccacagtagctcgctcgaataagtcctaagcaattaataggtccttaggtaattatcaaaccctagattttgtataatattttctctgtcccacggtgtaagaagaaaaaatatgttataaaataattgttattttaatttataatttaatattaatttttatttatatattttataatattaaaaatataagctaaaaataaaataaaaattaatgataataaaattaattttaaaaattattattattattattattatcattatttaatttatatagattataatttaaaaccacaattataatggaaagaaatagatgtgcatgtagaaaaggcaagcttgtttgtttaatatggcttggtttgcagtagagagaatcaataatatggaaattatttattgtatgaaagaggaattgttggggggagaaggaatgaacacgaacgaatgagaaacaaagcatgcatgaaaatgatgatagatctgaaaaaaagtgcatgcccttattgccctcacgtcactcaccgcataattggaattggacggtgtaaacagcaactaaaccaccgccacagccaccttctatcatcaatttgcgtgttgcttcctttattactttaataataatcccataaccactttcactttcttaataacaagttacccaataaataagaacgagttgtacttgtattaaatacttgtaaaaatatatataacttacagttttgtctgatctaaacggattggaattctctttatttattagaatttttcagcaagagatatataaacacaatcaatatcaaaattatgttcacattttttaagtatatgtttaacttattcttcgtgtgcttaaaaaatttgaacatgattttttgttatttaaaaatcaacataattaatattgcactttttttagagatgattttgattatatattttaaactataacatgcaaaacttataaaaaaaaacaataattaaatgagtttttatatattatatcaataattataactattatgataacgatatttactttcgtctttacatttttagactattttattttttactaaccggatattttaactgtatattaaaaaatcatttcactaacagaaacaagcacactctctttttctgtataacctttttcatttatttttaaaaataagagacacgaaagtaaataatactttgtttattttaattttaacattgattggatattgatatattcttaatattaaaagaaataagtatggggggagggggaatattcaattattggggctctcactttcaaagttttggtgattttgatactgtcattgatgttttgggtcttccttaattaattgtttcattttcaatttttctttgcagagagagagagagaacaatgcaatatgcattagatcaataatacatacgtatgaatctcttttattttaaattttttattttttttcatttctcatctcttatcatgttataaattttattaattttttttctttttttgcctagatgtctaataacatatcaaatatttttctatgcattatgcggtttatcacacttcccaatcgtacacacgtgaacatgatgcaatgcaacctatctactacttcggctttatgctgaaaacgacacccatctttataaattacacctatgcaacttgccctgttaaagaatgtgacaccgtcaaatactatcattcaattatgttaatcaaataaactactactcgatcgttctaagtttaatttaagcctattccaaatatgtaaaatcataagagacatcaagtcactattcgatatagttatacagataatgttttcagtatcactttaattcgttttagtaagttgttaatttatggattcatctagataacgttttttaaaatatttattaaaaattataaaataaaccacacttttgagtggttttaacatatgttaaacttcatcaccagtctactgaaaaaatatttttttagtgagtattcttacgatactgattaaagaattaaacaaagattttttttaattgtatgagagtacatttaaaatttacatataaactcatttttttatcctagttagagataacatatctcctattaaataaatcagtgaattatcccgcttgtactgtataactgttgttagtccaaaaaatatttatataagaaaaaaattaaatataaattttttattaaataaattattttttatatgtgaatacatcgagatcttacgtcactataataatattatagttgagaaatatatttttacatattctataaaaatattttttttttacacatttttactttttccgatctcaattttacttaatcactagtttacaactactcatagttcttaagggttgtcttgcaaccaagccaatgttaatagtttaaatgaaagcaaacctatatacacactagtttcattaaaatttctttttcaaaaaaaataataataatgttccttttgtttccagcacttcctaagttcaattatatagtatcatcaatcaggagttcgcataggccactatgattctcaaaagacgaggaacatttaagaattatagtagaacagtattgcactgatatcttgtaaataattaaatacacccaaataattaataaggatgtatgatattattcattttattttttacactataatattctgatcatgtcattgatttctgatacgggacatatgagacgtataacttagtggcctgtatgtataattttccccctcgaataatatggctgttatatagctaggcaacaatcgttatcattgtcaaaaaaatgcacaacttccctttgatttattaaacaaggtacgattattaagcacttaggccttagctagactaggaacaggcatagctatgattttaagcatcactcactactttgtttagggttcatggtggagataattcaggattttgcttattttattttactttttttcttttgaatttctaaattgtaattcttttagctttgaatattcgttgatttctagatcctccactacctcgcaattgtagtaccttctagcaattgacagttgatacacattccacagatctttagatattgaattcttttgattatcactttcttttccttttttctttctttttacttgtttaatcttgacacccaaacagctcaattaacccactgaaatggaaccttaaaatgattatattgcccatcatttacgttggtttttaatatgacttactttttataattaaaagaaattttacatattgtattaacgaagctgtttttcatatataaattgttgtgaaactttttgtttaatactattgtgattgtttaagaaactgtttttaacattcatttttactactccctccttggtagttgtggttttatataagaaaccaatgattttttttttgtgctaattatattaaacattgattcattttcaagtgtattaattattacttttttaattaaaatatattcttactttattgtcaatttgttaacacctactcatttttcacgcaattgaatgcattcctcggcctattgatcatataagtcaattatttgcggggtgagagaaattatctattgcatatatgtaatgttatatcattaaatataattattactccaacaatttaattctatgagtatttctagaataaaatttaatttatattattaataatgactaattaacttaactaatttaattgatcttgataaattagttatttatttcttatataaaagagtataatttatttattttttacttaagaatatgactagctaatcatcacacttatttattttggtattttaattaaagcttaatcactaataaaaaaaaactttagataacacatgcacttttatttgccatatctagctaatcatatcatgatatcgagaataacaaccttgaaaatagagtagtattttttatttgtacataaatacacaaaggacttttgatgattggcaaattgtaaagccaattaaagaccagactgtaacattaaaagggcattgtcatttttccttaaatgattggtataatagagattagataatttcttcattaatatcctaatccttaaactatttgatggtaaaaaggttataagtaatctatgattcttcctaacaagtactcttaattctttaactaaaaaaattcacagtttttttatgcattgcctttttctttgacttggttggaccaacaatagtaattactttgtgctgatgatagtagtgctcagcattttcagtttggaccagatgtaacaatggaaaatcaaatgggagggattggtacacaattgtactcacgcaacattagagtcaagaagtagtgccgtgaccaagcattattaatttaagggattccacaaatgtcaaattaacacttaaacgctggtgacttttattgttattccttcatttttgtttgtgataaaactaaaaagcaatgaatgtagttgagtagtttctgtcctttgagtgtggtcaggtcaacaattggggttggatcgagagagtgaagtctttttctgtcgaattgaatttcaatggtggataatgctaaagcaagctcaccttgttagcacaaaattagtagtcctacaagtttgacatatttgaaaaaaaacattttccttggtctatgaagtggacaacgtggctcaatgggtgcgatcacttagcacaatagggtatgaattgtagtacaaaagtggttcccttgggataggcatataatgtttcacaatttagttggcattgagtggcttgtgatggtaaaagtaataatgctggattagaacttgtaagttagaattttcatcaaccaagcaattgggttgataatgttgccctttgggtgcataacattttcaagagaaacccggaaatcttatctaaatgcacatgcatggttaaacaaaaggccaaattgataattcataatgtcactaaccgtaagctgacaggtcctcttttagagaagtcgcttctgagtgattagtgttttttttgcccttctttttattgtattacttttcattttgggtcatggagcaaatgatataaacaaaattttcatttcttcatgttgatcattagtgaaatagaaagtatgtgtatatatgatttaagcatatcctctttggttaattgcttagatatttccacttaggcatacaatcttttggtgtttgtcccctaatgtttgagcatctcatccatcaagcccccaccacctttgaactcaactatcccacacatttgtccatataaaattatctctttccctgtctatgaatgtgaactgtatatgtgccagatgctaaaacagtcaacttacatttctagattattattattcgcacttttagttggtccctgtgaattttttatatataaatataaattgttcgtgtgatttttaaaatgagtatccaattgagcactgtatatccaggcctcttaggcccaatctttctgccaaataaaatccagtaatgcaggatttttagattgagtgggattgggcttgaacgtggagtttggggttgttgcttcctgcatttcccaagttactttctgcactcttttcggaatatttttttgacctcccggataggtcattttggaagccaaaacgaaagtgcattctgaaatgtaattttacattttggaaggcaaaattgagtgtaggaagcaatagcaagagtaatatctacaatactattaataagagttagtttcttgatctgtaaaaaaaaaaaaaagagtttgattcttgagcaatggcttagcattggccacttcttcccgcatcccaacaatcacagcctacataccttgtaaattctagattagataattcggaatataaaaccttcattttgaattaaccctttcatagtaaaagagggtgtcaagtgatattgttggaggtgtatgaagaagagacccttaacaataagcaagagaagtgaagggtttttttttttttttaagataacagaagtgaagtgaagttgaagtttcataatttctgtgccaggacaaaaagacttcaaaaatgtcaggtgacacttgatttaagtgtttattttttataaaaaaaaatatttttctattttttaagatttcaaaaatatttatcaaaaagaaaatactttaaaagtgttactatgttttcacttcttcaaaaatgcaaaaaaggttgatttgttcttttcaattttggatatttttttcaaatattttttaagaaaaatgtttactaaattttaaacaaacatattttcacttttatttaaaaataaaaactgaaaacgttcaaaccaaatgtgacctaagtcttgcatagagaattcttgatggagattcttagatacattaaatgtaagacatgagattttagatgcatcaaatgtactttaagtcgattcaaaacctcataaacgaaaacatataatgaagcctttaaagaattgaatgacttaataatagttaacacactaacacaattttgttctctttacaagttagtttatttaatttcattttggcttgtaagtttgttaggccaatatgattataatgtagcggaaaaataattccgcagccgggattggaacccggaaattcaaatctgagaatttaaccaaatacgctactgcggatttgatgatattgcacccaaattgtgtaatttattatataatgtttaattcgaatcatatgcgtttgctttagaaaatttgctaaatcttggtgattataggaggaaaaggaattaccacaacaattagttgacaattatgagaaattgtaaacaaatatcaaattgataggattaaaagaaagtgatttttttttaatatcaaaagcggatttttttgtacgatgaaaaaacattattacaaatttacaatgagaaaccaatgtgtcttacaaaatgttaataatacgcttttttaacacattctttattattaattaaaattgacttaaaaatacaaaatttatttaggttctatttcatatttaagaaggcccctttatgatttcgtaacttctaatatttttacagtaaaaaaattctaatatttttataactaaagattacaaaaataactatgataaataatttatgactttgatttgattattatcaatggaatctgtcatatttaggcgagacttaataattatctatttttagatttttacccatttttaaatattcttgcctttttgttcaatttaaaaaaaaaaaaattagacaagccaccataaattagtcatcaaaaatattttttctaaagaaaaaaaatcagtcataagcagactaaatttgcattataataattttccttttgaagctggagatgattctaaaactttctgatgaattttaaagaattgaatgagttaactcattttattttcaagttagtttatttaatttcatttttgggttctaacttgtaagtcacacaatgttcttgtttttttaaatgaattcaaaagtttttttttttctccagcaacagggttaagccaattaaccaatatgagataatcacagatctaaaaaaatattaaatagcgctattttattttttaaaataagactatttatttttgttgtgtaatagaggaataaacataaaaaagatttgtatattatgaacaatcaacaaataaacttaacactatactttaactcaaattaactcaaaataaggctaaagtttttgaattcttctttcacttgtatggttctaatactaaggggggtaatttttttctttctaaaattaccaaatagggctacatttcaaaaaattacccgaccagggatgtaatttatgacttttgattaaaagtggaacaccaatttatgacttttgattaaaagtggaacaccaatttataagtattgagttttggttttttatttattttcctgcttgaattcgtaaaagtagttcgactttatctaattgtctgaaaaaacgaatttgtttttttttaaagtcgtagtcaagatttcaacttcttaattttctttttcttttaaactttcctcaccaatttacgttttttgtctttaatattaaaataattatattaatttttttataatacttattttacaaacataattaattcataaattataaaaatattaaacaaaaacttaaactaaaacttacgtaacttaaactagaactaaaacctacaaaataaaactgttttttttttaagtctcaaacatcctctacaactactatttccaacatataaataaaaaataaaaaataagaagttgcaagtttatctatgacttctaaaaaaatagatttcatgacaagtcagagaaatttttatgaatttaaaaagaaaaataagaataattaagaattcagaagtcgtaaattggtgttttgacatctacaacttacactttatcagataattcttttgaatgtaatttttttaaaataacgagcctttcctaaaaaataaataaatagccttaattcaaagttttactcaaggaaaagcatagtttgagaatggtaataatgcaactatgcaagggaagtattgacgtagcttgttaaaaggaaaaaaaaaaaaaaaaaaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnaatcaaaattattccgcagccgggattcgaacccggaaattcaacattagaatttaaccatgtgagctactgcggatattatattaaatctgtgcaaacacttttatttgttgaagtattgtattcgaatcatcacagataaattgttacccatctttctcttataataataatgatttatttaaaattttggataaagtttaggaatatatttaagacatagtacgattaatatgtctttaaattatttagcctgttaaaaagctaaaaagtgtaagtgtctagtttgcattggtgaagtctcaactatatatgtgattttgtgttgcaaagagactaaactttgcgacatgaaaagccatatactgtttacaacggttgaaagaagaattgcccccattaagattccaagatacaaatgcacaccaatttttttatttgaacataaaaaatgtaaaataacattatatatagtacgttatatatgttagagttagagattattatttttttacatgaaagagtttaattttatatagacggttttattgtataatacaccgtataattttacaccgccaattaattagaaattatcattaatataaattttaatttattaattattataaaagttaattaacttattatatattataatttatgattaaataatataaaaatattttacgctatccatacatacattatttactcgatatattattcttatatacaacagtttttatacaaaccatttttaaaaaatatttattacataacgtattttttatcttatattccttttttttgttttttatttcttttcttatatataaaagatgctgtgagaagatattataaaaataatgtattactttatataattatttttatctttcactttttttcccttcatatatacatgtctaaaaaaatacacttcaaaatcaaagttgaaaaaatattgtcgtccatttgaagtattgcaggaataattgtcattttgtagtcactactttggatccttccttcgtggaagtgttggaattggctccccggtaaataatgtgtaatgtgttacataaaaggggcagcaaccttaacatgggggagtatcaatccagcacatattttcatctggctgaagaagatgtggtggttggtcatgcatgtggtagtgttgttgatagtggtgaggggttttcctcctgtggatttcacatagaagatgcttagctccttttctgaagtattcatttgcaaactcccacctatcagcagctaccttcttgaaaccctgaaaaagaaaagaaaaggaaaggtatatatatgtgtgtgtatgctgtttcacacacatgagttaatcatgaagcttgtgtagctagctaggtaatcataagttagtcttatagttcaaatagtgaaggaaaatacttttgaagtttttatactataaaagattccactttctaactcatctgaattagtattttgattaggctaactttgtcaagaagtgtagcacaaaaaaaataatcttctctgaattggtaatatgattaggctaactttgtcaagaagtgtaccacaaaagcaataattaaggatagatcagaacaaaaaaaagttatatatatagaagagatggattctcacataggtatttagctgcctaacaaagcttgagaagttgttgtgcttgaaatagttgggaagaagatctctagcaaactccgggggcctcttcacaacaaatgtagtttcatcatcaccccaagagacaatgtggtcagtgcgagggtcatcaacaagtttgtatgtctttgttagaaagggagcaggcactgacttgagagattccatagtgaacaccatgctatcttcacacctgtctagtgtgaaagccatcactgaattaccaaagagggctagctgcttccaatattattctttgatggtactctccttttcattcacttttttcacaccaccaagttttaaagaacctctctcactctatcatattataatttgaaaaatgatgcatggacacttatgtgctactagacacttagacagagatagagacaaatgaaagagaaaagtaaatatgatggttaatatgatgtgataagaaaagatagataaaagaaataaaaagtgttcactaagtgtatacactaactatgctgatattcatatatcattactcttataattttacagctttatgcaacagaaacatatgacatatttcttaaataactattctttgtcctaccccctctattatgtctgttgtttactaaatttaagaagcatatgaccatgtctgtaaaaacaatgtatttttctaggataggatataattaataagattcaatgagctattaattagctattgattgttttctcggatgcaatagtggtgggttgtgattcctctagagatgtgagctacttactattttattttggaggaaaaacagtgggatatatttttataagatattctccaaaatttggagaggtgtatggggatatattaatcaaaacttaaaatgtactgagatggggttgttagatcatttcatttgagtttgaagttaaaaaaatttgtaaagactgcataatacagtgattttttatggatacaaagatctcatgtcctctgcaaattcctagaacaataattaaatagaaaggtgatattttaagtatttctttctgtataacacatactaatagtgtggaactgaaacttggaaggttgcgatagtcctccaacttaaagagaaaatacttacttttatgtatattcattggcccactattatatatgaatgtcagaagttgttcaatttgttggtccctccctctcctccaccctcgtctttacttggaaactagaaccaaagcctgctttgctatatattttttttccaataaaagacgaggtattctcaacttcgcatgctttttggcatctgtaatagagaattaatttgctaattggactgatctgttttgtattaaattttaatcatatatataagttccccagaatgatacctatgtaaaatttccatccaaaatgaatacttagaagccagaaaggaagtatatgactataaggaaacaagccattttatttttgaataatgattctttcatgatacttgaatgttgaaacacatcactatacattatagataaaaaaagaagataaactaaactataaaatgttacatgaaactatatgcatatggcactatttttaatttttcatcatcagatattcatatctagcaagatcattcaagattatcatttacacataagtgaggatcagtagtactgttcttccttctttggtttaatctcatccatgcttcaacaatcccattcaaataaagtactaataaggattgatgggatagaaactttcttagatcacccaaatcatgactttttgatttccagcttgagaaaagtagtgtctcagaaaccagaaaagataaacactgttcaagaattatgtggttgtaattttcctttttttttcccagctatcatgtccatcccgccctttattttctgaagaaataccttttcttcttttatagggatatttgtggggatcactgttgggttgtgatcacgaggatcaccattttaaatcttttcccactacagctatatgtcaaagtttgcctcctgtacataactacagaacataatagaaataaggctattatataaattgtaaacactcaaagtgcttcgtacctagttttcaaggtagaacattctgacctttattcatttttgtacaatccaaagcacacccgtgacctggacatatagaagatgtatttccttctagtcatcaatcatggaataatgtatttatatatacactgcacaattcctatataagtgaatcttctgtaatttgaccagataaggtgtatatatattaatttcaattttcaatgctatgcctaattacattagagaaggaagaaaatgttgtgcacaaccttctagctctggattccattgttggagacattcatcactttctttctagtttgtttctttcttaatttccacactcttcttttctctctcgcttttgctttgaaaatgtatgtgttgaaattaagtgagatacttagctagctccattttctcatccaagcatctctttttgagtcttgaatttttggtggtcaaagtatagctaggaagcctctaatataccctgcatcacactgctaagaatctgaaaggtccacataaatatctcaataatgagaagattctattctaagttaatattaccaacacctacagtttccagtaaaaataggcaatatatgttgttgcatcacatgatctatctccatccatgtgacccactgcatgcctttttagatagaaagagagagagttttgtcttttatgtatcatgcacaaatctaaatgcataacatgtgaagatcagcatgtggcaactaaattaaaatagagaagaagatgcttccaaaagtgactattattggattaattagcaaaaaggggaggtttgaaagcttagtggtttttgtaaaagttaagaccgaggttaaattgcatgatttctcctttgaaatttgaagaacaggaactgtggctcttcttaaatatatgttcgatctttggaagttcaagagctttgaagaccaataaccatactttttgtttttgtttacgctaagtatctctgaaccgatagtcagagattaaattccttcgaaatgtaaaaatcaccaaagtgaatattttctctccaaacaaagtcttttatatacttgaggaattgaaccccttataacatgcacccacaaaaaaatgatagctagctataaccgtcaacttaatgcataaaaaaccattgaagtttattagcccaaaatatgattttgttgatcaggctcgtttgcatcatgcatagtactacatatgcataattaattctactgaactcagcttcattatttttcaaattcagttaaacaaaacgaaacataaactaatattttaagttgtatatgatgtggacgatgatatcaaacgtttgttgaggaagttagatccaattcttcttttctttgttgtaataaaattaagaaactaaaagaataaagattaattagcagtagtttaccgtagtcgagaggccttgagtcatatattctttggtattgagaaaatttgaataatatatcaaaatttcattcttttccttttgttctttctggtgacgttactaataaggtaaacattggcaggaatgtagataatacaattattcataataaaatagaatgaaaaataatgtgtcaatacatatatcatgtgtggtttatattttatatatactgcactggcttttcttacatatccacatccttagtggacgagaaactattcttttttctttttttttgaaaagaaaatcttagtggggggttctgatttgatgttttctaccttaataaagtcatacgaatcatatatgtgcttcctgcgaaggagtgcttcattacaacatgaagaattcacctccacatctcagccaaatgctgaaaattcacatgcgcggagggcaatgcaaacaagctttagtctatcaaccatttatatgtaaagtaattgttcctattacttggattttggcatcattacctctcatgcatttgtctagccagtggtgttacgttcacactgtataactctcttttcctattaactaggtcccatgtatataaaatattattttatcgcgcaaaactttctttacattgaaaaagtatccactggaaaatactatatatgtgattgattatatatcattattcttttaatttcattatttttaattacattgtatatatgcaaatagttgcattcttcacgtaaaaatgatgataaattggtgtaaggtggtaatgtaagaaaaataaaacggcactaagattaagatatgttacaatattattgtttctttattgaaagtggttttggtttagaatatgactaaagaattattgtcagaagcagtaatcacaacaccaagcattttcctttctctttttctctgaagaactttgtagtatacctaggaaagacaacaatttaggtcaagcagtgtgcagaaagcaaagagcattagaaaaattcagccatggtcgtgtatttaaaagtaaatggaaagggcaatttcataggcttttaacctttcgctctcttccatgtctgcatgcatacattttgttctctaatctttagcaacttaggtaccctttgtttccttttttttttttttttccctcgtgacggtcaaagtaaagccgtaatgcatttttgcaatgcaaagtaggcatgccatttaattcctcgtgattatcaattgttcgaatttagctccgatgccaatattttgatttttgtacgtttttaattttatatttaagagtttaacatataaataatttatgggctacaccatttggagacgggataaaacacttgactccttttttcctttcttgtaattttttttcttctaaaacaacattagagagaaaagtgaagacaattaacaaaagatgaatgataatatatttagatcctttccttttgatatattcttcattatccacccgtgtattaacataaagtcctcacactttggattaaaataatctaatagtgtactatctttagatatatgatttcatcatcgctcagcactttatatatatatatatatatatatatatatatatgaattaaatctgttacttatacacacaaaaaattatatttaggtacctttttacattaaatttcttttttttccctcaaattttactacttatattctcatattcattgttttttagtttagtttttacattacatttttttctttctcaaatctaagtgttccactcattaaattagagtacattatcttaaaaacttaatttcaagtcttcattctttttttttttataaaaaaaaaaataacaccttattaactgttctttcaaatnnnnnnnnnnnnnnnnnnngacaatgcataattttaaattaattatgcataatatcatttataattttaaacattttttcctttcaagttatactttttaaattttatctatatttagaatatttgtataatataatagaaactagttggttcctgttgaaataaacgctcactttatggaaagtaaatttatattcttgcgcacctaaactacaaccaatttttaagaaatttgagccatatttgaaatcaaattacaccttttttggttaaataattttttgttacaattcaacctctgtaagatacaaaatttattttaaatcatcgtaattcatatgcattttctattttcctttctttttagttttgacaaagtgcatcgccatttaagcattgacgtgttagcaacgggaagttgtactgctatatagcgtcttagatttgtgttaaaaccagtagtacaaaattgtactcttaacggaacatagatcccttcattacaaataaaagtacttcggcgtagtacatctaagcctagaagtaccacgcttgcaaaggctatatatatccacttaatcaaattggataaactcatcaaattgataaaacattattcaaagtccaatgttccagtttaggcaaagacatttccaatatatgtggaggtagagggttctacagggtcgtcctgagaccacatgaagcagattcagattacaagcatatttgtttgtgatcttttatgtgactcagctcatgtgttctcaggtcgcccctgccgaactttctctaccatgatacagcattggcatccaattccaatctattgcgaatgcactcagcacaaatgaaaatggagaagggcaaaagaatgtagaatgaaattcctattgcatgaatgtggtttaggtaattaagctacaggattatctatgtttgtggaattgcatattttaaggccagccatctgttatcttataggtaccataccttataaaagaaatcaaacaaataataataaaaataactagcatggattaaatcctgacaagaactaagcattaagtataaattaaactaaaatccttacagaagactcaatgactagtagctcttcttctgtaagtttcttccaacctccgcctaccatgggacatcctttctccccttgcaatggcaattcattgtttaattcactaaattctttggtctccctcatcttcttgacagttgaattatcaagttgcagaagatctaaaaaggcatctctcttggtaccatgtggggtcaatttccaattctcttccttttctgatacttgattctgttttgcatcatcgataatgtcatcaacaggaagacaacaagatgatacttgattctgtttttcatcatcaataatgttaagaacaggaagacaaccagatgacccaacagcacggggcaacatgccaattggacacgggttccatgattttgccaaagtccaagtctgtaattttttggtgtcacaatccattgccattggttttttatttttcattatctgttgtttaactaactctagctttttagctgcttcgagcatggattcctcaaattggaaaatgttctttgaagttaataaagggctttcatcatctgcactctctaaattggacagactaataagagagaactttcgaactttctccatcaagtagctgtcgttcatcagctctgcaagctgaagtgctgaatccacgagctgcttgttgaaaagttgtgatactagaagacatctacgaagaagttcatgcaaaactctttttggcatatttgcttctgcagaaggaaatttactgagaattccaacaagccatgcaaacaaagaagaaagccgaaactctgttctcgagtgtgaaacccccatatttgggttatctacaaaaattaaaaaagaaaacacactatgagaacaataatgaagaaactaagcgtaataccaaaccaaaatgaaggacaagagaattttaaaactcaatatctgacttcacgttggctcaaggcagaagaaatactaaagggaatccaatcggaaaagactttccattagtagtgcatttaaaaagccctagaaagtatctggcatttaataagtaaataaatggggcatcaaatgacaaaagcacacaagaaaaatacatcccaagtaccccaaaacaaacagatattaaatttcaaccagaaactatacataatgaaaagggatactgtagaaggaaaaaattgctaccaaccttctttatacttcatatcttcccgactctcaatcatatcaaggacttccttaagaaggttcagaagtaattctggttccttattgcacaatttgagtatgacaagcatccaatcagccaaaacattctgagtggttagaccaattgaagcatcatctgcattctcttccaactcggaggaacttaaagctttcaacaaatactccaacaacacagaaacaatctctttggaaaaggaggaatataaccgaagaacatatttcaagatctttgcaatttgtttcttagatcctgaaagtatcacgattcactagtaattatacatgaataccctgaaacattaagctgaagatactctaaaacgaattatttcagtttcacttatttttcatagtaaaataaaaatatccaatatctcaggttaggaatctctcatttatttggtcgatcagctttaaggaaacccaacacttgagttttaaagaaagaaaaaatagaaacataaaaatatgaaatggccaggaatcctcttaaagcagaacgaacacaataaagaaagaaagaacacccactaacaaggtaaaccaatcttttagcataatcaacataggaactctcaaaaaccaacctgtgatttaaacccaacaaattggccaagaaaacactatcctttaagagaggttaagtagacacaattggtgttgcatcctttcttttctcttttattttttgttatgtggcctttagacacaatttacttctcctttaaaggatgacttgcccttcatcccttgcacaccattaattgtttcatggtttagttaatgtaaaacactcatacgaatggttaaggatgagagtgtttttgtacctataattatttagcttgttttttagtatatataggtgcaagggatttgtaacatttaattcattaagagaaaacataaggatacaaatcctttagagagcacacatgtgagaaataatgtgtgaattatttattgttgtgtcatctaagaccacacaaaatactcttatttatagtgaaaatcagcagggtggtttgttttagcggaagaacatagacaacgagaaacaggtttcagcctaggctaaagtttaggaacgaaaacctgctttgataccatgtgtgaattatttactgtcgtgtgtcatctaagaccacacaaaatactcttatttatagtgaaagaagttcacaaaataaggaaactaaataataatgagtaataaggaaaataatctcatcctactgtaattaaaacatatcaaatcatatatttcctaatcctaataaaggaaataaaggaaataaaggaaacaaataaactgatgatattcataataattagccactgatattccttgattttctaccgataaagaattcatagagaattcttctttgtaattttgttcttttcttattaaagaaattcttctttagttttgcacagtataaatttctctgtctgggacagtttttcacaacaggtatactaaacaaacacaacaaataagttttattgtaataagaaatatgaacaaaatgatacctccggttcgagatgtttgactcttgccaactataagagacaaaagcttattacgcccaaaaagcaattcaccatgcttgacccctttaaaagagaaaaaacacatcataagaattgtaggaaaaatatgcagttgaatgtcatcttaccaacaaaataacccatactgtcttgacttagaatacatttgaatatgatactacaccaataactctacatccattaataattgaaaaatgccttgacatgtgctaccattaccatatactaacattaccaataggctccactttataatgggccaaaggatttccaaccatcaaattttcatttcaacattaaattacatgctttcccatgggcacaagttacatgtacataaataaaacggaaaataggaaaacacaaaatagaactcttaatgaataggtggaaggaaggtatttgacttaaaataaacaagtgcaagacaatgattaaagtcacaatatgatcaaaatgaacaaagcttacagacgttttgcttttagtagtgaagaactagactgagcactcccattgactttcaagcagatagctaattcacgaatcttagacttaatttctttgttgacttttgctattccttcaccatgaaaaggaattgctttgctctgaggttcccaataataagattttaaccaatcaagtgcctgaaattattagcaaaacatcagatgagtttggggagtgagttaaacataattagtgtgacgggaatagccatacatgttaagaacttatgaagaaattgcccatattcaaatagctaaatccacaaaagaaaaccacgatgctttccatttttatttccagttacattttaacaacaaactgaaatttcatcagaacgaaaaatgaatgtacaacagtaagcgagtaatctaaaagttattacaaacagaaaataataatttttctgttgcaaaatagcatagatttcagtgactaccatgcatgtactctgtcctttgataccattaaaggagaaacatgatttctatttcatatactaaaaaatgttatgttacacacagactttgggaaagaaaagttcagtctaataatttcgtgaatgctaagaatgtaaccccaaccaaggaccacacacacttgctaagaatttaattacaaaaaagcaaaaagattgttgagacagatgatcaaacaaaccacgaaatgagtcataccttaacagaagcactgcggacaatcttaagtgaaggaagctcacgatgtgatccctctgcaattacagcaataaataagacaaaaagcagggcactataaacacaataaaacaagcaactaagtgaacttctttgactacaatgaagatcgtgtctcattctaccagcacaacaaaactaataattaacaggagtcaaaaggaaacttgttcaccatggcgaatatcaatcagcatgcgtggaataccaatcgcatcagctgccactgctatcgacgccacttctttcttgcgtgtcttctcaacaacacaattcacaagccttgaaaaatcaaaacaattatactttaaaatagaaaaattaaaaaaaaaattattagtgagaagaagaaaaaacataaaaaaaggtatagtgaccactgagcaaacctcatgatagccatacaatacagcatagcaagcatctcctccgaaagagaagcttcattccattgatcatgtctacaattaaatcaaacaaaattgcttattgtgatagtacatatatacattgatacatacatacatacatacaacatacatacatacataaggaaaggagttagggttacctgaaagatgggtctttgagttgaatttcgatgatggaagcagtgacttcgatgagaactggcaaggaacctcgacttcgccatgcggatatctgagggagcagaacatatggttaggttaggtttgcagttacagtactatgtctatctatattatgaatttgtatggttaagaaagttactcgtttgagaccggaggaaacagagtgaggagaatcggagaagagagcatttttaacaaagagccactcatcccagttcaaccaagggaccaatctatgtgcgcttgatgacgatgatgataactctgtaaccaccttcgcatcttcttcgaaccgtaataacaatgccggctccatcccgaacgtgcttccacttctgttctgaaaatactgagtgaaacgccaaagcctcggagctcgagggttttgcgctgtagtcgtaagaactaagaaccttttcttttgagaattttttttataatttatttatatcttctgttcttgttttctaaaataatttttttatttctaattttttaccatttaaaaaataagttaaatcaaagtaaattaaagtttaattatcgtctaacccaattagttaaatataatgcttaagttattataaattcctaattaaatcttcaatttctactaatcaacaataataaaaatttaattaattatttggtctctatgcaaacattttttattttttatgatttaatgcttatatcttttatattataacagcacaaggattaaaacataaaatttctattgtagaaaaaaaacataatttttttagatataaagacttaattcatcttgacttaagattattcaagtttaataagagacttttcatttaaatcctaaatatacaattgtattaaatatttatgagaattgttttgctgtctataataatcactaaaactcaatgtgagacaaattgtaggatccagattaattaaacagagaaaatatatttagattaaaaacttattttctgctttcaatagaaattggatgcaataagaagaatgccatacagcaggttcagttcttagggtttagcccaagatatacggtgaaccagggagtcaattcaaggcacattttatggtggtgctacccaaatgtatacactagactacattacaatatttctaacactaatttccatcatcatctatggaactgaataagaatgctcatgcaaatattctcgtaaaattgaccataacgtaatccaatccaataaattccatgtggtttatagctattatactttggatcatcatactttaccatttccttagaatacgagaccgacacattaaataacttcttgagtggtcatgatactaatatcttcttacatataactactttgagttttacagtattagtttaatttcagatcctccacttgattttcgtggtagctaaaactattgtttatttttctccaattgcttttgacacaatctatgcaactgtacattagtggaaaagataaaacaaaatatatttatttttctttatttgcacagaactggattaacatcttggtttttccactatgtcaaatgttgaaatttgactaaaaaaggatatcagaaattttctaagtgcaggctttggctcgctttactggggcctgaagggaatttagataaatggtatcctttttgtccagtccatcaaacagataactaaaaggtggcatttggatgtatctcccagtgccaggagtgacctttagttcattattttcccaaacaactcttcctcctgcaatagtcacttcaatttttccctgagaaaaataaaaactttgaatctggatattgcatgacaaggcttcaattgttgaacgatacacaaacaatcacatgttgaacagattataggtaaaccggtacctttcctcttcttccctcgtagacatttgtgtccagtctggagtggtgagactttgcactcatctcaaagctcgaatttggattcaggatgataatatctgcatcagatcctggcagaatagctcctttccttggatatatattgaagattttagcactgaaatgtttgtagaaatgaaaaacatcagtaatactttgggcatctttaccaaacagcttttttattgccataagaactggaagctaatttgcactttgattaactgaatatataccattcagtgcttgttatcctgacatagtcagtgacagatatttggccagattcctgtgagatatataaaccataagttctagctaaaaggttatgctcttcaccattttaccccgacctaaacagaaagggagggctaagctgtaagttgacatcttaccaccatgatatcccatatcaaatgcattctttcttcaatacctacaggttgcattctatatcagtaaggaaacatttcaaaatcagcaagaaagtatttagaccacaaatatccaagactttcatgtgattaccattgacaccattaggcattttccggaagtcatcgattccacgagctttttgggtggaattaaaggcacaatgatcagttcctaccagctacaaattttaaaaaggtatcctttggtcaaataaacaatctaagtaaaacgaataaaattgagctgagggcagcttgaagggtgtatttcatagctgagactatcctgagaaactcaaaccctcatctttaattggttattgaacctaagcctgaatcataatgtgaaacctgcaaaacgccggttgaaagggcagcttgaagggccttatcatgtcctcgtttcctaataggggggctcatgacatacctgaaacatgagaatgaataaggcttatatgttcttaaaattcaaggaaataaaagaacaacaataaaaaaacattgaaacaagtgaaggcacttgctttgctgcaatctcaaagtcaggatgccaaagccaagattcatcaagggctaacccagaggcaataggctctccaattaccctttgtcctgcagcacaagaacaggttaccttattattgcaaaaactaagttatcaaggaacaataacacttcaaatatcacagtggaaatgtgtaaagatccttttgttcatcttcattgagattcaggttcatcagtgatttttttttttttaggactgcatggaaagagggaaagtacacctagggatagaataagtactcctccaaataagagaagtacaaaacaaggagataggaaaaaataaagacaaagcagcaaggcaatccagtctctgtgtatcaaaaatagaatcttcctcaggaagctcttatcacaagtacaaaacagcaatcaaaattaagtctcagactctcaattaagttcaagtgatttgagttgccctcagtttctacactctatgatagagtagagacaacagtaaaacacgagtggatttataaattgctctcaagttaaccaatgtatggatgttataaattcaatcaaaatgtcttccttttgcatttctccctaaaaaagattgcaagagtattagtttttcttcaaaaggatttccaattttataagttataaatcatctactttctcttaatgaatgtatacattaataaaaattgagactaacacgagaaatattgacctgattttcgggctttcgcaatttcttccattgcgtcaatgctcattacatgaaccacatataaaggagtattcacaaaatctgctaagcgaatggcacgagcagttgcctctccttccaactgcacagataacaaagtcaaatgggagaatgttctataaatcacacagacagacatttaaactttgcagtgatcacaaaatattagagaacaaaacatgtaatcaagatgataaaatactggctaaacgtggttaatgagtttatcataacagatgaaagctgaacacaacaaatgtcaaactagggtggtcacaagcaagcaaaatttgatagtagtagcttaaaacagttaatttggctcaagtacagcacctaaatccaattcattatgcagggaggctactaagttgaaaagggaaattttaaatatgaggagtacaaatcacattcacatatgctataggttggtcagacaatgaagatgaaaagaaacaaaaaatgtccaatattttcattccattattctgcaaattctttattaaaagaacaaaattgagaaattaccactgcaggccttgaaagagcatgcccctcaggaccagttattccaagttctatcattttctgttgcccttcatacacagcatctccattttctgcatggaccatggctacggcaccaagagacttgcattttttaaatccttccagaagaagctcatcattgatcataagaattcctttgtatgccatgaaaaacttaaaagagttgattcctgcaattacaaaacatggatgtactacctggaataaattccttacaactcacccaaagggttactaccacctaatcaaccaaattatcaaaatgcagcaaggaaataataaataacaacctttctccttaaccatgagctccatttctctcgaaacagtttcatcccatttggtaataaccatatgaaaaccataatccatgcaagacttctttgccttcttttcatagtcttcaaaaccagctgtcaaactcccattaagtggtataacgaagtcaatgtgcattgttgtcccaccagccaatgctgccgcctgaccactgaagaagtcatcaaccgttgcagtaaaaccaacatccatatctagatgggtgtgaggatcaatgccccctggtcagttaacaaaaggagcattcatagagtctatcaggcacataataataacaacaataatgatgatgacgatgacgatgataaattaattttcatgcactttttacattgtttaccaattaaaaatcattcgacttatgatttttttaattagttattataaaaatcatcaaacttagcatacatggcaatgggttgctccacacttatatatactatttttgtcatattgttagtcaacagggcatgaagtttacaaaattggacatttatgaagatctgacaacagcccgatatagggtggtccgatgctatcttaaatttgaggttgagataataaggtaaaaaatatgtatactatccacacaatctaatttatttatttttatatataagaatcgaagacagttaccaaggagtttacaccaactcatgctttctaatttaatctaacaataataggtaatgaaatataattgaataggttgaaacctggcatgacatatttgccggtggcatcaatgacagtgacgtcatctccaacctgggaatggaaataaatcatacatcagaaagcagaaagtaacaaaaacgcaaggtgttagaaagcaaattaagcactgttactgctagggggtttcaattcatcaaataccctgatgttaggattaactgcaacaatgatgccatcttccacgtaaacatcagcaatctggtggtgctgagtattcacaaccgtgccacccttgatcaacaacttggatgatggaatttcagttcccgcatcacaaaactaaatcattcgaaaaagaaaatcatgaattaagcatagaactattggaaataaaaatctcagttcagtaatcagtactaatgatcatacccagttaaaacactcaagaatcgaagctctaactctttgataacgtagaacgggataagtaaattagttgagcaaaggtcaacacagaagagaagtaaatcagtgtaacggattctacactgacattcacttacaatttttgtatgtgcggtaataagtttgttgacttttacaataactaacttaaaaatcatatctattctgattaaaattttgtacatcgatagtgcataattaaaatatgtaggaaaacgaagataagatagagaagtgaacctggttggattgtgaaagtgaagaggtaatgataatgaagaaggtaagagagaagatatgaaggaattgtgatgtgatactgaactgcatactgttccgaccagacacactcaactcaagtgtcggagttgctatctcagtcaacgaggagcctgttctgtttggatcgctgctggaaagaacaaaaaataagttgcaatggcggtgcaataatggattgtgctttcgaacacttcagttaaaggtaagtttttttttttttttcttttctttgatggcttatatggtgagaactttgtttattttatccggaacagaccttctcattcttaacaaaattaaaggtaagttttttatttatttcatgttttaaaattttcctattagcagtttttgtgtctttttaaaatattagatatttgacatattttttatatatgatatgaaaaaactgttttagctctattaggaaaggtactgttttaagtataatctcattcacctaaggattgagttaattaactggagcggccaacaactactctggtctgagtggaattaaatccaattaccagagtggaattaaatccaattttattaaacaaggtagtcagatttgattaataaagtttatagatatttatgtaggtctcaaatatgtaattttttttattattattaatatgatattttaatcaattgagttaatagaataattatattaaaaataattaaaattgttatatataatactaaaaatttatatatgtaaaaaatatatgattaaaattaattattataaaatttattaaagtgttatgctaataatacgaatgcggcacgttcaagacttgcaatgcccataggaattgacaattattttcgatttttcctctcttgggtgtactaagaaatatgttagatgtagaaagaaaatcccaacgacactaaataaaccgagcccaacccaaacagaaaacaaactatcaggaaggttacttctcttcttctctctcgaattttccctgacttttgtgtgcatcgatggcggcgatcagtctccggaaagggaacacgcggctgccgccggaggtgaaccgcgtgctgtacgttcggaaccttcccttcaacatcacgagcgaggagatgtacgacatcttcggtaagtacggcgccattcggcagatccgcatcggcaccaacaaggacactcgcggaacggccttcgtcgtctacgaggacatctacgacgccaaaaccgccgtcgaccacctctccggcttcaacgtcgccaaccgctacctcatcgttctctactaccagcaagcgaagatgagcaagaagttcgatcagaagaagaaggaggacgagatcgcccgcatgcaggagaagtacggcgtctccaccaaagataagtaattaaatacttccttctcggaaaagcctagggttagggttagggttttcgagactctgtttggtggttatattgtattcttattattgttggatttagtataagtgactatgaattaatgtttacgatgctatcattatttgtgagaatgaaatgaaatataaattcatcggagatgcaatgccttgtggttgttagttaggggttttcgagaaactcgtctctgtatttatgtcgttgttcgagttgctattgaatactagtataaacgtttaagatcaattgtggcgatgtttcttcgagtgcgattcagacgccttgagtgaactgaattgaacattgcttcgaactctacaacgcaatttgtagtgaattgaattagtgttaatttcgttgatgttacgtttgaatatcgatgcatagctgaattcagctttagtttcaagagtggaaagcttatataatgtattatggtttatgcttctgccagcgtgagagagttagcaaggggagagagggaagaaacagagagagagatgaacaaaaaagagtgggatgacaatacaagggtaatttcttggttatttcttttgttgtattttcagaaatctgaagtggggggacttgaacattgttgctcccagctttttgtaggacttttctctttggtaaatttaggtttttcctttctttctcaatgttctgtttaccatctttgtattgaacatcttgaatgagaatcaatgaaatttgtttctgcaagtcaagtgtatgaggttccgtgatggtttatccttctgttttcctaatctgaatttttttggtgagcctagtgtaataaaaatataaacttaataataataatgaatgtatttgaacctagtgttgaaaaggaatcagtagattcagtcataaataaataattcttttgatttgattcctaagtgagcagtgattacaatacaagatttgttgcaatgtttctcagcatatgaaaaggaaaagtaaaaaccaaaaccaaccaatcaaatacctagcatatgttaacatttctcagaggttggtttaagttttttcccccctctaaatttgtttgttttccaccttgacactgcttaaagagatgatgatgcctgttaaatatctttgcacagtccccaactaaaataaggttgagtcacgcctcttcttggtaccaacttctagggttcctttgttcatcattgcagcaaactcatcgtagttaatccggccatcctgcacagacatacaagtttttcagaatttttcatagtcatgattcagatatgctgtacagtagtatgctaattgttaagcacatatgctatagaaagttttttgtattcaaactagagaagtgttagcaatgcattctttattattgattgcaatttattgaaaatcacataattttcttctgggtctcaattaatttaatgagtttcatattatgattttgtagttttcgataaactttgaccattaaatactttaatagaaaatgtgttagcaggagggtgccaacactcctcttagaactatgagtatttaattcatccagtataggacttacattatctgcgtcaacttctgaaatgatttccttcatgtccctgccatcattcatgttaaactcaactagtgcctgctctaattcttcaatggtaatgtacctgattatgacaaagccatgagattagaaccttcaacttataaccaatcaatttcaaaaaaggagtggctgatatatattcaatctagttgctttttctttacccgctgttatctttgtcaaagtattggaaggcagtataaagatgatcttctttgttcattcggttcatgtgcattgttgcggtaatgaattcatcataatctatggttccgttgccatcagcatctgcctgtaatatacagaaggaaaataaagaaaatagtcttaagtaatggcatcagagaaattactgatgggaagttattttgtcatatgcagtactttgaaaaggagatataacttacagcttccattaattgcttaacttcctgttctgttagcttagtcccttgttttgcaagcccttgcttgagctcttcaattgtaatggttccactgttgtcagtgtccatccccttgaacatctgcttcaatcccatgatttcttcctcggataggcagcctgcgataacctatactcatatattgatttcacatcacattaattaattaatatataaattttaataccacactatttcatgagtcttgtgatacagtttttcctaaacaatggatagaataatgttcgatctgaactcggccgatgaaatgtgagatttgatttttaaattcttttgtccgatatgatctaaaaccgttccggatttaactcacaaaagctcgcaaaaactgagcttgagtctgaagtaaattttagtttttctagcgcaatttattataatctgtgacttgcatcaggataattagtttgtttttccacttctaactagaatcacgatagtgtaaatatgcacgaagaataaagagaaagctaaaatagcattacccttagagcaactttcttgaattcgttcattgctctgaactgtttgagcctattcagtactgcattgtcaagaggtgtatctggtgcttctccatcctccttgatccatggatgatctgtttttcacataaaataaaaaagggctttattagaattgcatagaaccaatttgtctgggctaaagtaaaattaatttgcaaatcaataattcgtagttgaattcaagatggtcatagaaaggaagtcaatattatacgcactcagaacttggtaggacgtcagcctctgcctgggatccgaatgcaacattttccttacaagatcttttgctgcaggtgaaatggatggccatggatcgcttgtaaagtctatatggcctcgtaggattgcattgaatatcccattttcggattctgtcaaaccatatgttttggtttcagtttcaaattgtgctgatataccatcaatttaagaagaattctattttgttaattaataagtagctttaagattgagtaaatgaatacaaacctgcccaaaatggaggaacaccgcatagaagaatgtataacatgacaccaatactccaaatatcaacttctggcccgtattttcttttcaagacctcaggtgcaatgtaatatgcactgccaacaatgtccttaaacatctctcctgtcaaaaagggatgaattccatgttagagtatgcttcattcgaatttgaagattgtgttatcatcctaagattattccaagcaacaaatatattgataattctgtctacatatagcttaagcaatctccaagctattgatgtttaatcacacattcaatcttatagcaaaaaaactctaaataaaaatcaaagagaagttctattaaaaggtggcactgttggtatgagttcttatcaatatctactacaaaagttttaaattggtgtcacggtgtaattttgtcgtgattcttatattgtaaaaaactacggacaagtgtaatcaataaaatcacagaaattccaaaaatcttgatgttgtagacgaaactgtttcttgtacgatttcttagaatattttggatgaaatttttttggaggatttcttaagtgaagaatttatttcttcaatttcttttttatttgagcaaatttatatgatagtgagagtttcttaaaataagacttttatcttctacaagaaactatttattaccaataaaaatatgtatttattttactgttttttctttaatgtcattgtatttaattatttaataattcaaaaaatataaaagtgagttttttaaaatttcttatcattttagcaaaattgtatataaatttcttacttaggacattttagaaatcacaaaaaaataacgtaacaaacttaagttaagaattttttattgaaaatgctcattgtagaaaactacggataagtgtaatcaatactatcacagaaatttcaaagatcttgaatcaatcaaattgcagtcacattctgttttttaaaaaaacctttacgcatggtggaatttaattataaaaaaacatgacagaagagccaattattagttccatgctaagcaaaccgtttccatgaccctagaaaacaaacatgtcatgcacgttcttccacggaaactaaactaactctctttttaatcaaataaaacatgataataaagaaagaaagaaagaagcaaaactagaagagtttctgggtgagaaatattgaccttgcttgtaaaaaacagagagaccgaaatcagtggccttgaggggtgcattttcatccttgttcaagagaaggaaattctcaggcttaagatctctatgaatgacccccatggaatggaaagtgtgaacaatctgcacaatggttctcaacaaggaagccgcagcacgctcagtgtaatgtccctttgcaatgatacgatcaaagagttcacccccagcacacaactccatcaccaaatgaacagattgcttgtcctcatacacattaacaagctccacaatgttaggttgccctgagagatggtgcatgatttgcacctccctcttaacatcctctatatcctccttgttaaccaattttctcttggcaatggtcttgcatgcatattgcttccctgtgctcttgtgtgtgcacaaatgtgtcacaccaaactggcctctccctagctctttccctatgctgtaagtgcttttcacgtcctccattggccttccaagcacggggccgatcgcggccggcttcgagtgcttggaaggaggatggttgggcttagatgatggtggtggggtggttatgggtgcggttgtgcctccgcctccacctccgcctccattgttgttgttggttggttggttggattctcccttgtcctcagtgccattggtgccacctgagcaacagttgcccatggtggaatggaagggagaacaggaacacaagggttgaaggaaggggaaggggatatgtggagagatattggtcaaggtggtacggtttgagggctgaacaacaatgtttttgttgttttctggagagaaggtgttggcatgaagaaaagtgtttgttgttgggaaagggaaaaaaatgtctagaaaaaaggtatggggaaatttgaaatggtgttaaaaagggttgtgaagaatattagagggaggcattaattggaaagattgaagaaattggaaagagtctttggcgagtctcttgctttggaaggttaagttttattaggacaagggtggagaggagttttcggagaggggaataaaaatggattttgttggtctattattacaggtcaaaggatctggaacaactcagttcaaagattttgcaagttgttactaacatcgcatactaatcttatagtttttgtttttgtagcgaaaatttgctaactctaaacgtgtctgatgagcatagtcttgaatatcttcttttcaatttgagtcaatacaactatgctacttatgatttgtatttcccttgttaacaatttttatacgtaagaagagaaatatgtcataagataagtagtatgatagaaaggtatagaaaaaaagaatgtgttgtagaaaaaataagtaagaataattcaaagtcatgtattattagtcgctccaatattggtttaatcttattaccttcattaaaaatattcataagtgatgaaactcataatgtaatatcatgttaaaaatattatatgactttgttaaaagttcttaagaagcttatttgaacttatattgttatataataacttatgttgaaaattggaagtgtttaattagttaaattgaggaaggaaacttatgataatttgcaagttatttttaatagataagattatttcagtactgtctatttgaaacaatttcatctgtggtggtctcataccataagctcttaatgattagattatttgccgcgacgtggcttattcttttcaattctttttagtttaaaataatcggtatctaaaaataatatataatcctgacgaatttaattcaaaatcagatacttatgttctcatacatgttctctctctatttgttttggatgtcgtatcattcatcaataataccaaatcctttacccaaaatttctcataataattacaaaagctgtaatttgtgataagcatgttgaatagggaggattacgcagtgtataaacaatcagcaaactgcgagatcaggaattgagagagaaagacaatttaaagatttggaaattatttagcaaaactcaaaaggttgagaaaaacagattttccatagatatttttgtcaaatattaagcaaattcacctttctctcttaaactaatgaaattagtctttttgttacataatgaaattagtcttccgggtaacaaaaaatgaatgaatttgtattctattttcctcatctttatttagaaaaagttcttttttgtatactgagcaaaaatgcaaatattatattcctaataaaatcgaaggaaattaatccatttgtactttacaaagtttgattccacgttctaagcattttgacaccgctttttatatatggttcttcttttcttttttaactcaagctgtgttatgaacctctctatgttgaggttgtgcatttagttgcaagagaatggtacgtgagaaaaggttaaaattgaattggttttaaaaattaaaagatcaaattgaattctaaaaaaaataaaaaatcaaattgaacctcaaataaattagagggaaaaaactaacttaatcaagaaaataacatgagaaaattgaacttgtagaattataatcatataatgaattttaatctaagacttatctcttcatctctctaattggaattctctcttctctaaaactaaccaataatgttcaaaattttacgaatgaaaaaaacaaagctttttatcaacaagaaaatatttgtttatcactttgaaaatttggtcacaaaaaacagtttatatttttctattttttatctgtagaaatcaaaacaacttgtgcacttgctcaaaacaacttgtgcacttgttcgactaactaagttagattcccttggttaaaaaaaaaaaaaaaaaacaannnnnnnnnnnnnnnnnnnnnnnnnnnnnnnnnnnnnnnnnnnnnaatcacctcacagccaaggccagcttcacaaaaactagcacttgatatgtagcctcttactcttgatccaaagtaaatacatgttcataccaagagaaatccaattcctaaaggtaacatggacatcccacaaaatcttgctctcatgtacaaagatggaaagtggaaaagtaaaggactacatttatggcagaataatgtaaatcaatatgtggggactgatggatcaacctggacagcataggcatggattcccccagaaagattgtataatttcctaaaaccctgaaaagttcaccaatcattaaattacaaagtacaaacaataaccactttactacaactagtgaaaaatgagaattaattcctaagttggtcaaatccacttccatatacgaaaattggtgagcaataggtatcaaaaaccatcatgagattttctttgatcaagttgaaagttgaaactgttaatccattagttgtctacagtctaaagcatctatatcttgtaagcaactatcacatgtaacatgtctaaagtcatacaattttacagtataacaataattgtctgcatggcttggaagttgcattgtgatatcaggaagtaaacaaataatgaggcaaaacacacatacacacacttgaacttgaaggcctgacaaaaagtggggaaaaaaaaaaaatacctgtgactgcaaccacttggcaacttgtaatgaccgcattccatgatgacactgcattcagaagtcaagatattgaatgcacagacacacaaaagaaaaaacattgctaaatcagacccaaatttaatcattttgtgcattgcagcaacaagttaactgagcggtcagacagactaaaatattaaatagtaaactattctgacaagaaagatgaatgaatttaaaattcaaaattattgctttattaaatatctcgaaaggcctctaaaaattcaaacttggactgcaaaggcaggaacctattcaaagaattccagtttcaatattgatcaacttacaacctctaaaccaataaaggaggagcaggaggagactagcaacatgaacagatctttcagacaagaacaataaagatatatactcaatcaatttagagaacagtaatcaataagcattagtggtctagtttcctggataccttctaatagaaatgacatcttttagaagaaaaactgcacttaccatgacatatgtattcttttgagggtcaaattttgtagttatttcaggtccccagcttccaaattgtcggaggggaagaacagtaaatcctggcaaagatgctttggccctgtgcatgttgagaatgtcatttaaatgaagaaaaaacagatcagctaataaaataaaaataagcaacctaggaagattccaaaaaatgcagaacaaaagaaaaatagatgcaaatatgtgtaagagctactaaatgaatatcccaaccagtcaaataaaagtagatccccttgttgcctttgagatgtcaaaagagcacaaacattgaaaattgaaatgctgtcaaactttcaatcgaactatatatcttattttcacttttttttaagctcattgcaaatcatatcagcttataatcactcacttggtctatttacaaacatttaaccaaatgcgatcaaacaataattcatttcaaaactaattatggttgaagaaaatatgagcatacacttcatcaggctctcgcacatcaattaattgtgcctcgtccaaaaagctgggatcttgaattttcacacgcagctcatcaggttgaatgtcttgaagaattgattcttccctatcaggtaaaggagcaaatttacaagccataagaacacatgttggaattaacaacaacaatcaccaaacattatctcactaggtggtgttggctaattgggtcaaaacaacaccattaggctctatcaaaagctaaaaattcaataatttttcattgaaattaaacaaattaaatcatccaattcataaacataagcctggaaatacctttcagataaaacctgcagcaggtgccatccaaatttcgttttgcaccttacaactttgtttaaaggtgcagtaaaggcagcctcttcaaattcaggaacctatcacattttcaccatcagtaaagcctaaaacaaggtttaatctaatcttaaaagcataccatttgtccctttctgacccacccaagcatccctccttcttctttggatggacacagtgaatattccacagcaagatcactcaaatcttcacctgcacacacaacaacagattcttagaatgataaacttgaaataaataaataaataaatatcttccgaaacctaaccccacacattggcaggagaaaaagaactgaattccctcggtgtcattaacctgaagagattctctgctgaagatacaacagaagcttctggtcatcttctttgaccaacaaatgctgcaccaatatctcccttggcctatcaccttcagcagcaccactagccccagtgccatacgaagctgaaaagacagaattttttaatgaaaaattacatctttttatgaaattctttttaccatcttacaaaaaaagtgaggatacataatctaatgctatcagaaacaaaattcccaagaagcattaaggggtttgcagagcactactagccccagtgccatacgaagctggaaaaaaaaaaaaaaacatttttttaatgaaaaattgcatctttttatgaaaatttttgtttgccatcttacaagaaagtgatgatacataatataatgcaatcagaaacaaaattcagaaacagaagcattaagggggtttgcacagaatgaggacctgttgctttgggaggcatgaagaccacaaagggtgaaagagggagtgaaagagggtggaaacggaaggttctggggaaagaggtgtgtgtgtgagtgttgtgagagagagaaagggagaataagaagattgagggatggaagcaaggttttggagttgccactcccactcttaactgacaaactgatctcaacattgacattgctgctattattgctatgtgctatttgtctggccgaaaacaatacacactttggtttcacatattcattatataaacacctcaagagtctaattatatggagagcaaaatttcacaaatattagttattaatttattaaagttttttaccagaatggattaaaaacatttttctcctttctttcttttttaagaacccaattaactttatatctccacgtcaaataaatgctatggacatgtaaatagtcaaatgcttaatttgatacttttttctattttcttatcactttgtattattaatcatattaattattaatagattatttaagttatgttgaacaaaatattttagttagtttttagtttattttactagttaaaaattttatttaaatgtttgataaataagtttttttaataaattctaacatttttaaacgctatttaaaatagtatttttttaacattaacttttaacttttttattttttatttttattcttaatttatttattttattttttagttatcatttttaaataaataattattatattattttttatcattttacacttttcatttattttaataattaattttatcgaacgctaatgatttaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattttttatggagaagattaaaaacagtattttttgaaattgaggaccaaaaatttaaatttaagaaacaaaacaaaaatgactcgaatttgatgattaaaaacatatttaagttattattaatccttcttctttttttattcacttaaatatgttttaatctctcaaatttaaagtaaatttattttttcccctcaaatttaaaattgattttttaattctttaatttgaggaaaattttagtccctcctcattccaaataccatcacagatttcacttacatgactaatgaattagtagtcatttacacgataactcattctaattttgcattcttatgatccaactccgcatcacatatgttttctttgcaaagtattcattgtgaaataatttgaacaaaaaacaattgggtagaacgactaaaacaatttttttataaaaaaaaaaaaattacagtgctaaaaagtattattgaattttgatacagttttctattatatttttttaggtcattatattttttatgtgtaactattattactcatttaaatttatctcatgggaattaagttctaccggttattcctcaaagaaaaagttctactagtactacttttgaattttggcaaaaaaaaatatcacaaatggtccaaatggtcaacaatttgtactagtgctttttaccaatttgtatatactcaatcacttatttacttagtggtcaacaacatgttgcatccaaatggtccaatatcatttcctcagacctcagtcaacaaaatgacttttattctgtatttacttttttccttagcttacacaaaattgaactttgtgacctgttctatctatagtctagtctcttacttgagcttagctcataaaaatgcttaccaacaactattacaacttacaagaacaaactattcctttctccttctaatagccatctcctaaaagtgaacctgaattagttccttgtggtgttgtacaatctgcaatgacatgtcaactcattctagcctctctaggtggaagttgagaaggaagcacccgaggaaccatttgaaggggtccaagcataaatgagtaagcccaaaatgaggataatggcccctgccataaagcctgttggaagagaggaggcaacaccaaggtatggcaatggcatggtgaacacgtagatggatattgggactgccacaaagccaaattgcattagttgggtatgtctcataatttttcaaaattgagtaactaaaataaataaatttaaatttaagggaccaaaaccaacggtgacctaaatttgaggaaccaaacatatatttaagcatacttcatcataacttccctcccgagcaagatgtccatataaacgagaaattattatacggttccaaactagaacgtttccatggttctgatcaatcttcacgtaatatgtacccgaattttattaactttctagaatatgaccactaacatgtgttggtcgagtaacattcagtaatttcaccaatataaacttcaatatagttatgcttggtgaaaaaattagcatacctgaaaatgtggaagcaagacaagatacaacagctgaagagatcttgaggagatgaagcaatgcaatattgaaacctatgtttacaataataaacagcagaggaagcagaggggcaccatcacatcctggaacaataaatcagtttctttcatttcaattaccattagaataagaatagaaaatgagaattttaagtcaactcttcaaacagataattgcaattcttctagaaattttacatgcaggtaatcttgccttgtgacatgactatgtaagagacagatgatctaggtaatcttgccagtatggtaacgtgcttaaaattgggagtgaaatatttaggaatgacttttcatacaattttttcatagctcattcctgaaattttcactctcatttttaagtggacaccaaacttaccgctataagatatgacaatatgaaaaggaaatatagcttaccacttgataatgtaccaacatttaggaagcaggctgcaccatctttaaggtagtttggtagttgactgaagggaatgccccataattttgacaagaaggggagaagaaggcacacgaatagggcctacactaagcatatattcttgcatttagacctttatttgcatttatatagtaaacacttcattgtaatccaaaagatgaacatttcatggaagattgcaggctacctacttggaaagcagatccgtacgaattgacaacaaaaaggtccatacaacagcctccctatttcagataatattgaatattgattagtatattcatgtcaagaaaagaaatgtcaggtttaaataggactagtttagcaacatgcatctgaaaattgtggtttggaagcttgagtctcgcacaatagaataatgcaaagtttaggttgggtattaaaatgagtccatcatgtatcactaaagtgaaagttttacatatactacaatttagtaatgttgttctctgcattatagtttgaggcgcatgtgcttgtgagtgcaaaagtagtgttattgcataattcaggttgtcaaatggcccaataagatcattcaaagccataattagcataaacatgaattaaaacaattcactattgtgcgaaccttcagttttcgggatgaatccaaaaagattatttcctgcaaagtatgaaaaggacagtgtaaactatagagaaatagtttgaaggttgggaaaatgcaacaaactttataaaccatgataaccttcagcacggtatcagccgcttggaggaaaaatgaaactatcatcaaaagactccaaaacataccaccttcctttaatgaattcccagcaccagctccactacaatagtaaacaaatgtataaataagaaggccatagaaagtaaccacaattttcatatagcttgtaccagacacatactttattcaacatgccttgggagaaaattctgtcagtccaagaattttgatgttgttgtgcagcatgaaagatgtaattaacatttgaaagcattatgttagatttcaataacaaagtagttttttaccaacaagcaacaatttcttagacttctgagtttatagaacaaacctaatagtatcataaaatcaatttgtttggcaaccttaataataattgtgtcaagatgcttagacttttcggagttagtttgttgacaacattgtttgtagaccatgttcattacttgtatcatggtatcatggttcaacaatgctccctttttgacactcataacctgagtcaccatggtctaagatccttaataaaattagaagtactactgaccttgctacagtaacaactacaccaatggttacaagaaagcatccaagtaattggttgactttatatcttctcccaagaaaaataattgacaggagtatttgccacactagaaaagtctgcaagaggatagctcaaattaattatctagctttattttacattttactaaacacctgcacaagttgtaaatatatgagctaaacacagattgtcatcctatagaacaatcaccagatgcaacagtaacaggaattaagaatatatgccagagagcaattgactgctgattggttttacctgagataaaattggaatcgatgctccagagagaattgctgatacaagaaagagcacaatagatgatcaattcagaatgtgaccatttccgtggagaaataaaattatacaactaaaagataatatatattcttagcatctccaactatagcagtccaagtctttatgctgtacattgtcaacactggaagtataagcattgtagagactgtaacaatttattacaaataatgggatactaaaaaagaatattctttaatcaacatatagcaatatttacatctatgaaatattctttaatcagttgcacagttgcaatctgagtatacacattccactctaaatctaatgaacactagggaggcctttctgccaactattctattaagcaaactaacaccaataaaattctattaatggcctactatagtctatatagtatgaatattagtgcatcatcacaaaacaaaacaaacttgatgtgctgatggaagaaattagaatgagttgaaaatgtgattgaaagggtgcaaagttacctcctgcggccattccagtggcagcagcaagagcctccaatagaccaacaactataaatggagcctttggagcatctaacatctcatcagtaacaatgcccgcatggtgtcgaatatacaaaatcgcaaagtacactattacatatctgaaatcaaataagcaacatcaatcgattttatgcttaattgtttggttatgcatgtttcaaagtcaattctctttcttgctgcctactttttgatattgagattaatttataatacatttatattaagttgtgtaacagttcaaaattaattctgtcaaaatcaattttgtaaacattaaaataaatggcctcacaatcacccaaatcaacatttgaccacaaaatcaccttaaaaggaaacaattcttggacacgaggagtgcacaaaagttatcacaaaaccatgtgatgattttaacgggtctaggtccacaagcataacgacaacccggcaaatttagcataaaaaataacaaaatgtacatttcaattattcaatataaattttaagttcctaaaaaaatacattttgagtttaaaagatatacacatttattataaaaataataaatttatcacatacatatatataataatttattattagattataatataaaacacatttatactgatattgcacatattattttttcatacatttttttaacaatttaatacatgtcaggatgtggtaattatttttaagtaaaataatattttgaactgaattgtaactgtaatagtatactataaaaaataccctaaattataccttgaaattacttataataaaagtaaatatatactataattatattatatgacagttgtccggacctagttgaattagttaaataagagtacttaatttattgcaagtccatggcataatctttattctaacgaataaaaaataaaaagacagttagaaccttaacgtaattcagttaaattctactatctttctcttttgtatttacccgaaagtggcaagttgagcaagaaagaaagggtactgcttcaacggaaccaaagccaacttatacagaacccggttcccaacacccagcaccaccgttgcaaccgccgccgccgccacttcaaccacccggttcctacttccgacaactgcatcgcttccgccatcttccgccaccctccgatcctccacggcgtaggagcaggggcccaccttctcctccctccctccgacgtcggatgtcacccacgcgccgccgcccacggtggtccccaccgcaaccaaccgcattggccgccggacggaataaccgtatcgaaccgcgcaaatcccggcgggccgatggaactgaaagtgaccggccggtgcggcggcggataaccgccggcataatgaagccatggtttaaatgaatttttttgtggaaaaacaattcacaaatcgatataatataattcagagatcacaaacacgaaactaagttttgagtcggagaaattgaggaatcaatagaagaacatcatttgttactaaggaatttgaagtttgtaatgtctgcgacaacactaccttgcctatgatttaattattgctacatcgcatcaacgtttctttaccttataatatcaaccacaaatactattttaatctacctatttctatattatatattcataaatattttcctttttcaaaaagatgttttcatttctgttgttgagagtagtagggtctacttcaatacaagtaagtaaaaagtgtttttgagaattttttattaaaaatataatatttttttttcataaaaaaattcttgtatataattaacttcaacacttatccagtggaggagaaagtgcaaagatctttgcaatcatacctttcatttttaaaaactgtttcgtgagtatttgtgttcttgagaattttatattcaaaatttgacagtggtattaataccatattctttttggtaatggtttgttttgttgttttcagttgccacacgggcaattatttattgttatgcaccgtttgattgtgtgttcaaagattatgccgatgaaaagggattccaatttcaaattgacttcttcactggtggaaatgcaatgaactcaactcaaagaaagatcgtcttgttgaatgataccaaagggatggttatcgtcaactgccacgttgcaaacagttactatcatatctcttaattatgcattccctctttcttatcattattaatatactatagaaaagagagttattccatgtttttttatatctggaaaattaggttatttttatattagtatctaaaaattcattttttttatcaaataatgatctggaaaaaaaaattcaatttagtatttattgttaatctcattctattaaataataatgtgataaatgaaatatcatgtcataaaatttaattactaacacgttattaaagatgatggtatggtaataatgtatcaattattaaatttgataatatgatactacatgttatcatttatcgagataagactaatcataagtattaagttcaaacataaaaaaaattcaattagttgtttgaaaaaaaaattaagtaataatattaaaatgatctatttttataatatgaaaaactgatttaaatcctacttttattttaaaacatatcgcaccgcgtgcgcaggaaaattctccgatgaagggagatcttttgtgcatcagaaaaagctttctgtgcactttttcagaaaaaaagaaaaaagctttctgtgaagggattttttctaacaaataaaggaataccgatacgagatactttacttaagaaaaaatatttatattttgacaaactatatttatattgtagtaattaatttatcattttttcacacatcaaagagagattaaaaatgtgaaataaaagaattaacgtgaccaaaaaagatatgaaaaatataaaaagtattaaataatataaagtttatattttattcaccaaaacataaagaaagcttttgacgatacatctccagggaaggatttacatgtaataataagaaaactacatttaagtatttaacaattgtcaacatttatagattccatgataataaataaatcatatgaattgtacattagatttaattcaaaattttaaaacattaaattttttgagttcttctcacttacgtgttattcaatatattcattttaaaattttagatagagtttaattacgagacaagtaaattaagttgtcaattcccctattaaggcatctaagtttcatgttagcaatcatgtctttaagcatatttccaattgtatctttgatgttattttgaatgaaatgcaataagtatatttctttaaaaaaaaacatgttttttttttcattcaatgtaagacttcttataattgccaaaaatacctaactaagacatgtgaatttaggcaattatcttatcttttctcttatttaggactttgtttatgttttttgatgtaaattgttaaattgtagtttgttctctttaacttgttattttgttagattgcatatgtttattaatggactattttgtaggacattgaattggattgaattgcattttttgagaagatgaaaaagaaagttgcaaagaaaaattagcttcagcaaaacaacttttagtttaagctaaatttggacaaaggtgcaaattataatatatgtttaaattcaaaatttttgacttggggacagacactcatttaagtagagattttttgggtctatataaatagattctttctttttaggggacgcttcgtcattgtattaaaacacctcctttattaaagttcttcttctccaactctctttttccattgttctttcatctttcttgcttttggatgttattcatggatatgggtagttaagtcctccattgatgggattagattgtatatgaacctttatgttctcatgtatttcttttgaaatagtgttatatatttatttttttcttcaatgttagttttttacttttatttttcatgtttattatgaattggctaagcatagcttgattcttggatgagatttctattggaaaatactttctttatcttgaattgtggtaaaatgctcattaaatctcgaagctaggaaaaggatgaggggtaatggttatctttgagtcattaagcttaaaacaagttttttttgttaaatgtgcaaggaattgacatttaatgaaagaacttaggtattttcaaaaatattaaagcattaaatatgtagatttttgtaaattataaagataaaggcacaataatgtaaatgtgtaacttttttttttttactttattttgaaactaaaataggcataagatcacttgaaaaggaaaaggtccaacaatatattactcaatatgtttatcaacactcaatatcaggcttcttacttacatttgccacttctatttcttttcaacgggaagtaattaaacttttttttccttcaaaacaaatactcaccacaagaaaatgtcatttagcaaccaataaataatcagtcgcaaatggccttttattcatcaattagtgaccgaatatgtttcagttgcaaacaatgacaaatttaatttgaaaattaatttgtcaaataaaccaaatatacttcagtcgtatgtattagagaaatatttctttatcagcgacggaaatttatacactcgctatgttttcttttgcagcgacagaaatttagtcagcagctgagttacaattataaagacaatatatattttcattcaattgattatgtattaatagttaggccaccctttgaattatttttttagttttttagtattatagtaattttgttgagcacaagagtcttctgttcaattatacaagtttaataactaatgcaagtgattgacataacagtatcatgcaaagtaatataatcaggcagtcattttcttgcacaagtcggatccttaaatatgtttttaatcctcaaatttgaggaagtctgttttagtcctcaaattaaaatttacactttttagtttctcaaatttacaaaaaaaaaaaaaaaaaaannnnnnnnnnnnnnnnnnnnnnnnnnnnnnnnnnnnnnnnnnnnnnnnnnnnnnnnaatgcacaatacatacagacagtctcttgcttgtaacatgtgaagaccagtaacatatattggaagcaagtcaaacagaacaacaatcacaattcacacaagataaagggaatttattgtgtaaaaagaaaaagaatgaccttaagtaaggattacaatcatttaagttttaacaggaaatctaacaacaacaatcacaatactttttcagatcaaatactgaactactagttctatgggaatgggcttagatggttaggaaaaagaaatgggctagcattagcataatgttacctgtcgatgaccatcccaaacactataactaaaagcgaattacaagggatgtcacaagtagagcaggtgcaacaagtcataatgtaaatgtttggttcaacttgttttaatattatgttatattgtgtaataacttttgaaaaaggaattatttcctcaaaattaagttaaactaacttgcaagttgcaatacgaagacaaaaaagacataaattactaaatccatagatcagattatcagaaacgttgttgctgattataatgacataggtctcttgcatcacaatcacttttctttggaccgtttcagaatcaccaacgcgaaaagaaataaagtcacgaaccttcatacttcacatttcacacttgacacataaaaggaaggttaaaacagacaaagataaatttaagaaaatatacaataagcttatgtggctcacacgcatcaattggacaagagaaccgggccgagcagtttaaaaaccccccttcactaagctatgaaggggcacatggaatttaaggtttacccttccccctcttgaacaagagaacatccatgacacgttgacaacctcaagcagtcaagctgcaacactatacatcaattataatctcagtcattttctggttcaatccaaatctttgggctggtaggagaatacaatatataacatgatacaaaaaatgttttgcccctcaagccttgtaatgaaaaatacaacgcaaaacacttgaatctattgcaagaaatttactagcacaaaagtggacaacccagcaatttaagttgaagaaatggaagtctgcataacaaaggcagatgaaaaagaagtgacctctgcaagctgaagaagacaaggaagcacacataaaattcacttgccaatccttcacttaaaaacaagatggcagcgcaggcccatgacaaacaaaagccaatacaacataaactatcacaagtaggacgactataagtgcaatcctgcaacatgcaaccatttagtcagtaagaccaaaataaatgagcataactatagctaaagattgattaatagtattatgaagttgtatgaaggaaacaagtttgttgcctactattttgaaataattctaaaaataaaactagtagagataattcaaattttacttaattgaactctcaccacacatgcttacatttattaatactaatgacatgtgtacaattgattttgataaaattaattttgaaccattgagcatgattagaatatgtccaaatttatgaccagagttatattgggacacgtgtttttgttagaaagtgcaggacatgattttccaacaccaaagcagaggctagatctaagtttgaaactgtctcatttatttctccattactcaggtatgggtgtgttctagttcactggatcagtttctatacattgaagttgaagggtttggtaataagaaggaaaataaaaatgttgtggcaatgcactgtttatgggaatttgtggtttgataagaatgcccacatcttcaagggtgttcctcacctcaacaagactgcacaactctcctacattgactagtttttaggagcattcattttttctcctcttttgtctttgccaaggatttcttatcccgcaacctttttcacttctacctcttcaactcttccattctctgataatttttcttcttttataattataagaaaaaaattaacagtggaattatttctatcaagaaaaatgttttggcaccttgggaagtttctaccaacacttcaagttccaaaccagaacctctaccttaatccccacacatccaaccacctaagtttaagcccagctggtttccatcggaatcctatcaaatatctaaaattttactctagatgattttaaggatattgacacatattccatttatgaacatccagttgataatgcaagaaataatataaaaaggatggagaaaaggtttcagattcattctagagactgcatttttttccttataagttcaactaataagactgaggtttagatcaagaacatacgtaagcttgacatttctccaccagacagtgcttctgaaacgacgagcttgtttcctgaagcgaaatgtgtttccttgcatattagcagttttatccaccagcaattccaaccgatcacctctatctaaaactttgtcaatattttctatcatgacattccgtacctgttaaagaacccaaaagaaaagaaaacacacatgagatcagaaaaacgaagtgaatcaaataaacataaggcccaattcggataaacttcttaacaaacacttatgagagaagaagataaagaggtaaaataaatcaagcttctctcacaagtcacaagttaaaatgaacttatagtctgatacagcttaacttttaaaagctctcatataataacttctctaaaagctaaagtgcatgactagattttaacttacaggagaagtttgatttattttatttctctatttcttctcgtataagtgtttatataaaagcctatccaaacaagacctgagtataaaatgtaaaattcaaagtgtatatcaaatagaaatgcttctcattagtcattattagatgtatttgtcccgttaatcacaaatttaatgtctatattacatttctaaggaacaattatcttgttcattggacttacgcagtgtttgaatagctgaaaaaggaagaaaagaactgaagttgaattaaatgcaattatactagttattaacttattaattctaccattgctaggattgttcagccacacactcaccagcacaattagttttcaattttcaattactgcataaaatcgaagagagagagagagagagagagagagagagagagagagagagagagagagagacgatacgatacctgagacatttcacctttgagacgattgatcctatcagcgttaggatcactggagtaatactccatttgctgactcaaaaccctagagaactcctcgttcattccgtaaggctgagcggagtgaacggcgcgtccgtaagtccgcacgaacttctgatgaatgtcctcgagaaacgcaaaaggaattctccctacagaaaaaaaaaacaaattcaaaatgttaaaaacgaataaattagggatttaggtttagaattgaacggatcgggaaaacgcactgccggcggtatcgtcggccatgcagagaacggtgagtccatcagtgcgtttgacgtggaagatgtagcgatcctgagagtaagaaacgtgcatgtcgttgttgccggggattttctcgagaatttgacgcgcgattgcgctggcgttggtggtggtgccgctgaactccgccagcaccaccgatccgcgacctaccagcgcgtatagaatccccattcggtttcggatcggagattaattgaaggaaggaacgatctacttcgacacacacaaaacccttttcttcttcttcttcttctttctcttgtgttcatccactgtcactttcttcttgactttttcctcttgcaaccactcgccaccttctgctttatgattggaattttaattattgactttggattttaccgcctttctaaaaaccaaaaaatgttcccccgcaattacaatttactattcaaaattgttaatttaacgttatgacaattataaagagttatcccatttactttttttttttttattacaagttcagtgtgtgtgttttgtaatttcttgtgtggattcacatctggtttatatagtaggccaaagtcaccaaactgatctacctttttttatattgcctttaatttacttttttttttttatcaatattacaatgacataaaatactattcaatacatagataaattgatactggatcgttctattttaaataatattagtctcgagttaaaatcattaatatataattaatttttaattcataattatatctttaacacagtgattgattgatagaggtattaattcttattcgtattcaaatataattaattttaattttttatataaatagtgattgtcatgcacaatttaagctaacaagttaaatatatatttaaaagttaatatgtatttttcaaacggaaatgttaacttttttgttagtttaattatggaaacaactgttacttttatttattttcttaacatactcccacttgatccctcccccaaacccctcacactatatgataagagtatccaaagacccctcccttcgtccttgtactccccatcgccctcttctccatcatcactcttctatctgtgtaatgtgtagtggtattagaaattgatgtatccaattaaagtattctctcttctgttgtgttctcatcaatatcacaccactcatctccacctacaacctagagtctagagaacatccctctaaatttctcatcttcagagcattgttacaacttacaatgttcactgatcaaaacaatatattcaatgtgatcataccttgcaaagggaaacaagatccttatcttattttttcctatgctgcatttgctgtcatgtaccgccagttttcaggactaagtcgtttgctcccatattcttttcgtggattaataacacttatgtttttggtttgtcattttgggtgggattttcattttttgtgtcatcaaatttggttatattttgcaatctcaatgaagttcctcctcccatgccatccaagaagtgaggatcttgtaccccaggaccaacaacaagatcaagacagagaatgcggtaatgctccaaacaaactgatgtaggcagtggtggatccacattaatgtgttggttgtaatttatttccttattttttttaaattacatataaatatattgagtgtgtaggttgtaaccctccacttttgtgtatttgatcctctgttcataatttttttacctattttataatatatattaattattaatttttttaaaataaattgcccctaactaagatcctagatctaccactagatgtaagcattaaggatgttttataaagttatttggagcattgcatttcatggtctgtttatttaagcactatgactgttagtgaaaatttaccctttgcttatacttggtggaacttttttttcgaaataattattaatgataattttagaattggtattctgtatttgtttctgaattttagtggaacctaattaatcttagtagtatttcttcccccttttgctgaaaaaaaaataaagatggtaaagagataattgttttcattctaagggctccagaatgataaagcttgataattccaacgattaaaattaaaatctccaaacaactcattttgtgaatatttataaatacaattttgataacatttttttcacacaataattctacatctcatcattttacacttattgttctcttaatttttttttgtgtgtttccttccgttttcacatagatgaatccttattaatagaaatattaatcttttttttttcttgcaaaaatttgtaatgttcgaaacttcgaataatgtctttaaatttttcagtaacttaaacatggagaccaactagattccggagcaatacggtgtgaagacttttcattcggggccaaaaaagtgaaaaatcaacaatcacaaatgaaacttggtggtggattcaaatcgctttagagtaactttaatgaaggatttaaggggagatctttgattgaagatctttcttttttcagatccattattaaagagagaatgcagatcttcacatggagatttggttctttctcaataatttttaagatctgcacggagtttaaaaaaataattttttatgtgattgatgaaaaaaaattaaaagttaaaattaattacttaaaattaattatatattttattaatattcatatattttttcatgctttattaatttatattaattacttaattaatttaattaaatttaaaatatttaaaaatgagatacatgtgagatccattaaaattatctaagatcttaatttgggatctacaaataaaataaaatatatcacaaatcttaagagatcttaaatactacgtgtcattatgggatccaccaaaaaatggtctaagatctcaatttgaaatctaccactaaaatgctcttacgacaaccttctttacataaaaaaaaaaggcctttgctaaatccactcccatttttttgctaagtattctttatatccataatgttcatgcataaccactattccaaaaaagtatacttttcaaaacaatgttttgttttaacattatgaaaaaatatttttagaacaaaattttatttttaagatttcataaagtattttccataatactatttttgtgtttcggaaagtagttttcagaataaaaataaaactgtgttatgaaaagtactttcaataatattgttttatgttccaaagattactttatggaatgtaaaaaaacaattagaaaaaattgaagcaaaatactaggatcattaaaaaccctatataaatatgaaaaaaatgtaatagtgaaaaaattgaagtggataaaacatattaattgatatcgattgctcaatctgaacaatttggataaatttaagatctagttatatattgctgcatatataaaatgagaaacattaatgatattgtgtgaatagacaaaaataaaacaagaaagtaaagtggtagagagtgtaaatatactacattgaaatttggaggataagaaaacctttatgatagaccaagaaaccaagaaaaaagggagtggaagagagggaatgaagaatatttgaaaaggaaaaattatttaagtaacttgatttaaaaaaaaaaaaaggaaaaggagagtggatataacaatagccaaaataacgttgttattgaagatgaatggataaatattacaattttgtataaatttttcacaaacacatatataatgaaataatttacatattttaaaatttaaacgtattactctcttatctccaaatatgttatggttatttaattactggaaatactaagaagtagctagacaaatatgatacttgtatgaaagtttaaatttagtaggtactataggttttaagtttgtttatgtcaataaagagagaaaaaaaatcaactttataaatttattgggcttaagtagaaatattaacccctcttcccccaagaaaactaaaactcaaatatagttgagtttggatccagtggattcaaaattataggagtaagagacaaaatataaaaacttataaggcttgcttgtgaattttggtgaagtgcgaggcacgaaagctacttctcaaataatcatattcccactctttcttcagtatctactagctttaaatccctcatcaatctgtctaatgctatatcttccattcatcaacagattctggagcaaaaaacactgtgattcctattcataaaatgaatatgattgaatcttgctatggcccttaattgaagtacgtacatgtctgtggcatttttacctaagggcatctttcacaacatgacattttgtatcaaaaaatccatgcatgaatgcagaatatgaatacaataccatgcggacataaggataatataaatagtacttcgtaggacacgatatggatacagctatagcacatcataaaaaaattgtataaaattagcataaaaatataaagaactcatgttttaaaagacactgtgatgggttattgtgaacatttattagacgttgtaatttatttattctgatgtgtatgttgtaatttatttagttaccatggtattcttcccatctatattttgaaatgttcctgattaattaaaattttcttgtatatatatatatatcactgagatactgttgggtcagtgagaaacaggtttgtttgtacttatttttcatgcatcaaatgcaatcacaacaaaagcatgtgcaacagagaaaaattaaattttacgtataaaggtggataatatccactacgtaccagaaacactatatggggatgtaatttatatggatacttaggttatagaaactctttttttaagtgaatttggtaagccgtgtatgcaagatggagaattcgatttaatgaaccttggattttttttatttatagaattcagtaatctaaccaagataaatactacatagcatttcataatgtgaagatcaaacttaaataagaatgtttcttttgttttgtgagtaatgattttgataagggtaggaccaggggaggaagaaacaaaaatatctaccatcttctcttcggtttacgtgaaaacgatatatagcttctttcataaatacacaaatatataagactaccatgatggttccaagtaatcatggtgacaagcagctgaaagtatccaatgaatgctaaaatagcaaaccataatgaatctgtgaatcatcaagtttatttggcagatagtcattgcaatatgcaagtatacaacaatgtagtaccaaagaaggactacgtgaccttttgacttttcagaactagtaattcataattgaaattaacaatattgttcttctcctcatccttgcgatttttcagactgaacgttgctgcctcaaccacccttgtgagaaagatttctttcaatatgggtcacatgtggcgtgagttttaagtggcattattgtttattggacaatggccgtctaaggaatcaaagtttttggatataatctgtttagataacatcagaaaaacatgatgaccatgtcttcttaaaacactttttttagtaatcctcttaaaaataattaattttcttggtataaagtgataaaattattaaaaagaataatcacgtcatatagaattatgaattgcaggcctgtttatgcttgttttgcacttaaaacgcgtattggatctttctatgtttatttcctttctaataatgtttttatgctaaagtatggggaccattcatttcgagtggggacatgatcagtggcggagcataagattggtgggggtggcaattctttcccccctcaaaaataaaattttaagttttgtcatcactatttatggtaattccaaaaacaaacatgccatttagaaaaaagttttacatttctcagtaatcatgataatccaaaaacttaagtcattacaatttataattaatattgaaatggaaactctgagaggagaaagagcaagttaattagaggaaaccaatttgcatggctaggtacttgacaacgtacacaattaatgaggactcgattggtattaggtatatttatacttaattaatactaagtcaggaaataaaaaaatgataatcaatctgaaaattggataagaaagatagaaatcaacaagtttttgaaaagaattttaaaataaaatacaaatttgatttaaggacaaaagtgtccagggaatgacaggcacatatatctctttcagttgggcaaaggcaaaactattactgtgcttcttgtatgcacaaggtatcaagttctagcaccaatcaataatatttctgaaaagatatttagtttagatagcatttcttccatttcaaaataactaatgtttaagtctttgaaaaaaattcaaattgattgatgttattattttttaatgaaatatgtaaatatctatttctgtcatgtaataaataatgttattttagaagatccaataaaatatttattgaaattaagagaaaaaataatgatattttaataaaattatctcctaataaatattaattttcttgaaacacttattttattggtttgtgtaaaaaaatattaaacattagtcattttaaaatagaaggagtataatataatagaaagagatagaaaaaaataaatgttaatgggatatttataaagaactcctcttatatttttttaaagatgttttataaggctattcctctagtattgttctatccttgggtacaaaaagtactagtggggtgtgtaccacctgacagatccctctatgtgtgtttttttaacatatgttccttctcatgttaactttttttttttttttttttttttttnnnnnnnccatggttttgacattgcgcgttcctacccactttgactcgtagcccgatgctaagttggggcaaacaattcagtcagcacaattttttttggttaattaagtttataattcttaactttttcatattataatttatgatctcttaaaatattttaataatttttagtcattcggttattttttcatcataacttttagttcctcttttttcatttttaattcctaatttttttattgctcaagagtaattttaaatataaaataaataaaagattaaagattagcaaaacaataattaattatgaacaataaaaataaacaaaagattaaaaatatgcaaaaaaattagaaagactaaaattactaacagaaaataaataaaggattaaaagtagtataaaaattctaaaggactaaaaattgaaatttataaaaattgagagactaaaaatttaatttaactatttttaatccaaaaatattaattgttagaatgctaattttttattagtaaaaggagattaaactcgtgatcttgtcttcttttttttctccttcaatcattcaacccatgatatatctcaaattcactaagcataataaatggaataaccatttgattttattttttctttagtacaagaatgtgttactaaattatgccttaagttcattgcaacattgaaatataaacttatttataatctggtttgcttgtattggcagtgaattttgagtttggaccaccgtgagacatgatggtatgagaatgtgatgggttgggtggtgacacaaaaaaggtacccaaaagacaaagcctagcaagtttaacctcattcattcatcgtttccttgttctaaccgaaccagacaaattgtccagagcagcaattccaccggctaccttcacaaccggtcaccccctcaacaactctgtcccatgttacttcttttctaccaccgcacgaggcaatgccaagtgcgaaatgagacaaacaaagaccaatgaaatgctcttatcacaattgcaccctctttattatttttagtattataataactataaacattatattatatatatgtatgtatatgcgatgggtttgttgcagtgtaagctaagcttcaatgactattttaactttcacatcttctttcataatgaaaagaccagaaaaatacaaaataaagaatggtagatggctctaatacaaagccataattatgactctgtgctgtttctttttcatcccttttttcctttttctaaaaaacaatgtgttactggcatgttgattaaaaaaagaaggaaaaaagagtacccacttggactgttcaaaattatttctataaataaggagttgaaataagataataaattgttcatcatcctctgggcattctcacacttttcgagtgtgaattaataaccccctttgatttttgaaatactaaatcaattttggtactattaatatttttttttctttaaaaaaaaaagagacatcacgtgcaaacattttatctttgctttgaacatatttctttttgtattttaactttaatgtgactctaaaatttaaattgcttgatgctgttaatcatgatagtacagtatatttgaacctcatacattaattagtgccttaatttgtttagttgtcacaataatacttattttgaacttcctaattttacaagaaaagaattactccttttataagttagaatcaaaacacccctttgttgcattaattgatcataaacacgaacatatattgcattacccaagttcaaatccatttcatcataaaccagattttctccttttaaacaaaactaataaaaaaatagaaaagcatgcgatacagcatgttctaggtgtttcatcatagagctttgcggctcatgtgcagaacagaagaggcaatcacggaataacaggaagttgtttcctacattatctcaaaactatttttccactgcaactcttcggattcgtaaaattaaaatcatttttgtcctaatcaatgaaattgacactaattttaaactcaaaactaaaataatttaaccaaattattagatacaaagtgtttaatacacctaagttaaagttaatttaatgaaaaaattattaatcaacctttatttatctttcagtcaaattttagaataataatttttttaaaaatattataaaagttgataaacttattatataattgttagtttgagcagaatagagaatttgaatttcttaaacgatatagattgagctttacctatgaaaataaataaaattattagaagagaatatctcagtatatattcttcagtttttgttgaataaaaagtgacaaaatggagaaatactccctcaatatcacgatgtaggacaccaatgaaatcgtgcagccttaaacagtaattttacccaaactcggttttcatttgattccttgattcataggggtactaaatgatctgtgaaaagaggttactcatcaaacaagattttttagtaagatcagaatttcacctaaaaaaatgattgtctatacctagattgcataaattatttattcaaactaaaaatgtaaactattttttttctaaaactttatttgatgtgatcgatatctgaagattttaaatttttataaggtagtagataaaaaatttaaggaggtgaatgaatttgaattagaatcatcaccatcccaaaccaaaatcctaccatccatctgagaccattatttatgtgtttaggtaacattcataatttacaggcactaactctggtatgttgctgacgtggctcattttcattggacagttacctgacaagacttaaacttgactatatcggacacaatgcccttgccttccctccccctctttctctctctacccttcattctctctctacctccacactctcagaagacaccagaagtaggtgaaaagcaaagaaccctttcttctcttgagatttttcacaccaccaccacaacacaaccactgtttcttgctcctcgcacctaatctgcctcaaaaagtgcgaaaaaatcgccaaggaagtgacggaaaattgaaaccccagaagggcaaggtcttgcccttgttgtggcttatgtgaggatacaatcgagttgggatttttgaaccctaggtgctgaaagtttgaggtttttcagtcagatctcatcgattttggtgttgtggctgttggggttggagctcactcgtggatctctctgatgggttgactcaatagggaactgtgattggttttgtggggttttcaaatgttgaaaggttaattttttttatttttttttgtggggtgatggggttttgtttgggtttgaagtgagtggcaatgctggttcttcagtgatactgtgtttgtgtggaaatgtctgctccttcagcggcttttgagcgaccgagacctggggcttctaatacggtacgttttgttttggaggggcagatattatgttgactttttttattgaaaataatcgatctcgagttaatgcacattgtaatttaggtaagtttaactgaaatttagtcataagattaattttcttttgaataaaattaatattttcagtgcatgttagtttagttaaagatttttttttttttttttttttgcatttataattatgtggcaatgaacgggatttatgtgggcaatgtgattgatagttgctggcatgttggaggctgagattagtacctcagttttcatctttatttgtttactcttttgttaaatttaataaggaattttacagtttggactttggaggatgaaagtatataccgaacagattggcaggtgagtcaagtgaaaagaaaatatattgagcaatttaacccattaagtaaaacctattaagacacccgtttactgaactacattgccaaaatgtggaaaaactaggaaaaaaatatagggtagttgacaaatttgaagaatatatactgttcttaaataattataatcttgatatctactattcctaaatatgatgctattagtatttaccaaaggatcaacttggatttggagtgggtgggggctgtcatgcattttggttacacttgtttcatttcaattaggtttagtctggagctaccctgtggttcctaacagatgttactatttggcaggtttttaaaagtggcccacttttcatatcttcaaaaggttggtgtctgaatctctgtctcccctgattgtttatttcttgttgtttattttcatattctcttgaaaggagttttttgtttgtttattttggtagcttcttgtaaccactaaagaatcactgaaagaaaactgtttaaacttgcagaactttgagggtctgcacctcccactgcccaattggcccctatcctcttacaaaatgacaagatatccctccctcaaaacaccccttcttatttataggaaaaatgccttaaccaaactatcttaaataactaactcactaatataactaagagaaaaaagactatgcactgataatgtaagaggatgacagttttactctgtcatccaatcacaacccaccctttatggtaagtttgttaacttttacaataaatctacctaagaagtcatatcaacgatgatttgtaattgtatgatagtgtaaaactattttgcaccatcagtgcatgaccattaagctctataactaatagataggcaactactgacctattgtaactatctactaatggggagtacctaacatttctgttctctgtggatggtatttattatattcaaattaatcaatgatataggaatttatcaatgttatcccattttgatcttctgtaggaataggctggaagtcttggaagaagcggtggtttatactcacacgcacgtcattggtctttttcaaaaatgatcctgttagtatctctcaaatctttctcattcttgctatgatctttatttgatatctttttgtgttctgttgttctgtgtgattcaattctcaattaagcagatatggttacagatcatgattttgataacaaaaattaatatagtgattgatttagctttcttgatatatgaattaattaacattttatggatatactttgtgctgatatgttttggaaaaatggcattttatttactttacagttcttattggagagtaatacgtgactgtagactaatagagaattgaataatactataaaagtcttagctattagtgctgatttattttactctaatgtattaactatcaagttacttttgttgttattatttataattgtctttactttgattggtcatgtagagtgcccttccacagagaggtggtgaagtaaacctgacattggggggtattgacttaaacaattcagggaggtatgttggataaattgattttttgtagttgtaaattttggtgtcaatctgtctaaaagttgtgaattttattttccagtgttgtagttagagaagacaaaaagcttcttacggtattatttccagatggacgtgatgggcgagcattcacacttaaggtgatgtgtttattatatttttaagtgaatgagaattaaattcaattgtactacttctaaatgtctttttaattgttgggccatataaattctgattgttttctcaaatatcaggctgagacatcagaagacctgcttgaatggaagacagctcttgaacaagccctcgcacaggcaccaagtgctgcccttgttatgggacacaatgggatttttcggagtgacgcaagtgattctattgaagggtctttccatcaatgtatgtgctcattattccttaaatcttattcattttatgtttactagcttatatcagttataggtcaattctggtgttgctaggattctgtattttttattttaaatttcttaacattttatttataggtttttacggatttttgtcatccttctttttcaatagaaaaaaatctgtcctcattttcactatattttgtgcggtgcttccagggagggacaaacgtccaattaagtctctggttgttggaagaccaattctgctggcactagaagatattgatggaggcccatctttccttgaaaaagctcttcggtttctagagaagtatggtaagttatgatcttctattatatatgtgatgcatctgcatttcatttcactttttctcctctcatgattcaaattttaggagttacttgttcagctttatttctctataggcagtttgttcaaaatttgttggctagtcggtctgtctggataagtgaaccctgtgcttaagttttccaatattttgttcaactggagatcatgttgcattggatattttggtttttctttattggttgtgttacgtattacgttaaaatgcaaattacctcttcaaccttgaccctttggagaatagcctgtgatttaaaatgttgtaaattaagctacttaatcgttaaatagcaacattggtgtgcaattattgaagcacattggacactaaagctcatctatcagcaaagcagatgattcctttgtttaataatttgagtgccttccatgtgatgttgatatggctttctgcaaaagcacctgactgcataatgacaaagaaaaatgttgaatgcacgacttctaccctatttttcagtgaagggcttctgctgattttactatttttaatttgcaggaactaaagttgaaggaatactgcgacagtctgcagatgtggaggaagtagataggagagttcaagaatatgaacaaggtacaaacagttatcttaaacgtcctagcactttacatgcatttgaagagagtaggttgttggtacttggtacagataacgttaatgaagttaattgggcttcaagaaaaaaaaaatagcaatgaagttcattggggaaacagcaaggagagaaaaaaacataggggaaaggaaatctaactttcataaatcctgatcatccaaaattacaaaaaggtgtttagagaggggtagaagagatttctaaccaagcatatctatgcaccttttcaagaactttatattgttctgaagtagttgttctttcttgccatccaatttatgttataaattatgctggctacttttagaatcagccactgtctatatggaaccgatgttatgaatatttttgtagttcaacccttctgttggtgaaagaccaataaagataatatccagacgtagacactcagtttaatatatggatttattttttgatacatgaaacttatgaatgccttgttcttaattgatatttccaggcaagactgaatttggtcctgaggaggatgcccatgttgttggtgactgtgttaaggtatttatactagttttccatcattggttatttaatgaacataaatatttggggaaaaaagcaaactatatgttgaactctaatcatggagaagaaaatcctctatctaatatttgacatacctacaaacactaggaagtaggaaatatggtagtatctaacctacacatcattcaacagtgggtacagagaattattgatctcaattttatgtaaagtaaagtaaggactacacaagaaatagtataagaaatcctccttaaacatagaagcaattgagtgcagaacaaaatcattaaatcaaaaactgacaatcacattaattattagtgtaaaagagctcaattgctctgcatgtctattgtctactaggtaaaaattctgaaagagactgaatgctgatctgggaagaaaggcataaaaatgagttaaattttgggaagatttctagtgccaaaccatcatgttcatgcaaccagtcttaaaaccaccgaccctacttgcatattagatatcagtcataatagctattaaagatcacactaacaagaattgctggaggaccatttataaagctgttgtatgcttctgaaagaaacattgcagcagcaatttttgttttacatatcattaccagcagtagcaaacccccttttattcaagtactcatcagtatcacctattagcttctagtctaaaagcctgtacaatctaaatgaaatctggtgtactttgtaaaatttattaatataagagcaccaggcttttttaatagtttttctgtgcttacaattaagaccttgaggccatgacctgtaatcaatcatgcattcttccatcagcatgcctgaattggagcagctattattttggtaaaatcaatctaattaatacggatcctggatttttaaaatgttttgttggattatgcattttatttaatgacaatccactgggtatatttacagcatgttctaagggagctgccttcttctccagttccagcttcatgctgcactgctttgttggaggcttatagtaagttgagctctatgtttaatttctttatgattatatgttctgaataggtggtttagttttgttcttttgaaatgctgctaattgctctatttattttgcttttttttccttctattttttttatggaatatgtttgacctttggaaaatataacaacttatcctttttctttttttaaaaaagctgttaatcttgaaaatttgctgtgaaatattgaaatgtgtggacgagttcagctatgtttggcccaccttttttatgtggcttaaaagctactttaaatttgtgtttgatgtcagttactatcattgactgtcctatttaaatctcacctatttttttcccctcattttaactttatttgcttcttatcttggatgtgcaaatttgcttatgttgatatgtctaatgcttatgtactttccatcacaaattgttcagttgttgagttttgttgcttttatcttgttctctggatgtgaatatatgcttgagttaattgttactatttttattttacaagaaattgatcgcaaggaagctaggattaatgcaatgcgctgtgctatattggagacttttccagagccaaatcgacgtttgttacagaggtgctctctctatctctctctctctttcttctccccgctgccttggcaatgacacacacacacactattctttccatttgttgtatcttgttcttgtatttgagtttgctatggaataattatggtagaataattaaaaattgcacttgaagagaatgtatattgggttttcttgatttctgtttggtttcattttaagttagaacctttatgtttttggagttttgttcaggtttatgtggctttaagaaaagagcctctaaaaactacaattcaatgaagttttcactatcttaccctaagatatttgtaacctatgataatatctggtgatatgatagaagattggtgtaatacccattgaggaaaagatgacaaaatcggttaaggtggtttgggcatgtacaaagaaggccacaagaagcgccaattagcagagtagattgcatgattttttagcccaggaaaaggagaagagggaaaccaaaatggacgttggaataaatcatcaagggagatctcagacttaataatatttctgaaactttggtttttaactgtgccgaatggcgttgtgtgatccatgtagccgacctcacctagtgagataaggctttattgttgttgataatatctggtgatgaggaataacctgttgcagttattattatgttgataagtagtaataataccttaaatttgtagcctgcttaatctgagaaatgcacttgtataatcttaaaatgacaaaaacaaatacccttaattttttcaccataatttaattgttatctctacctttgcagaattctgaagatgatgcatacaattggttctcattctcaggagaatagaatgactccatctgctgttgctgcttgcatggcacccttgctcttacggcctctgctagctggagaatgtgaactggaggatgaatttgatgccagtggtgatagttcggcccagcttcttgctgctgctaatgctgctaataatgctcaagcagttattacaactttgttagaggagtatgagaatatatttgatgtaagaaactctcaatcaatttgtattcttttgattatttgctttctggtttgtgtatgattacaattaggaaaattaacttcaagttgctgcataaccttcatttatgttttgtttagcctgaggtatcctgattactcttgggctcacccttttttctgtccttgtatgggattcttttgcttgtaccgaagatgcaaacttactatgaagttttgctacgggacttgttcatcaagttaactgttgctataaatttcaatccgtagattgtataatgagctaaaaaggtttgacctcttgtagcatacattgttcctataatgcaactaaaattgaatgtcgattcatgtgactaatgatttacccatggtcagttggcagtgtttgctaaattttgcaattccaaaaatgtatgttttcattccttgattcaattctaccaccttagtttttatctgcggtttcaggaagaaaatatacagagatgttccatgtcagcagattctcaggttgaaaacagtgggagtgaagattctactgatgatgataatatagatgtgaaagaaaatggttaccatgatgcggagaatgaagttgatcaggagacggatgatgatgctgatcgtattcagagtggaaaattgagtgagagtagtggttatgctggcagtgatctttatgattacaaggttatctcctgcaatgttattttctctgttatagagatttatattgattaagctcttgccgtgagtagcaatgttattttcttttctctctatcctcttaaactcttctttgtgatcctgcaggcatttggaggtgatgattcagatgttggatcctccagtagtaaccatgctaagactgaaaatgctaatctgaatgctgtttcagataccccaccactgtctgaggatcaaaacaagcaaagaaagggcagtgaaaatccagttgatgagaatgatgcttcaaatttgttgccttcaactgaatcttatcgatccatgggtgagattttatcttctatggaccccggcaaccttttgcccatgccagtgattgaatcaggttctggaaagcaaacaagtaaagctagtagcgctagtttcagttctaagcggtcggcattctggggaaggagcaatgtgagttgttattttttgaccatttacagcctaacaactttgtaggatatctaaactcagtgtgaatatagaatgtgagttgttacaggaatcacaattacactaacaaccatttataggacaatcatacatttatgtgatactgagttactgacaatatatttgcaataagctgccattaaaatatgcagacttaatatgctagcagtggatatacttaaattatgtttgaggcaaaactgatgcagacttaatatgctagcagtggatatacttaaattatgttatgtgaggcaaaactgatattttctattgtagttttgaattttcaaggtaaatacatggcatctgataatttttttgatttaagcagccaaggaagacaccatcagtggaatccgttgattcttctggagaagaggagtaagatacttagctttgtactttttttctttgtataatgtgctcttggattgtgattcttgatagaattccaagttattcttcaatgtcttcttatagattttttggataggtggtgttaggttctctagcttggcttttttcatcagctgtaacagctatgttttgttatcttcttgcattacgtgatttgctttatacctgtcttccttttttcacctttttttcttctttcaattttataccttgaaaacaaataactaatacttttgatgcctgtaggcttgctattcagagactagagattgcaaaaagtgatttgcaacacagaattgcaaaggaggtggatttcttatgcctacttatttttatgctgaatcatataacgaataattttttttaatggaattggtcttattttcattttaggctagaggcaatgcaattttacaagcaagcttagagagaaggaagcaagctttgcatgagcggcgcttggcacttgaacaagatgtacatattgatatatctccctccaatatgaattgtaactgtttaaatttaatttgctggtttgccctgtgctttgctgcttgtttttaatgtggcatgtgatttcattttctgcacattcttgggtttgacattcctgacatcatttttactgttttttttctttaaattgatttcacccttaaatttaaattgattaaaatattcttgcagaaaccaaaaatggtttctaatgaattttccttgtgtattactacaacttatgcaagatgtggttgttaataatggaactactttacattgatttatgatatggataaaatgcattctacactaatggaggtttatcaaaaaatataatttaaagtgttacttgctggaagggttttccatattggaaaaatgttttttcttttatattctgaatggcattttaaagctcttttgaatgtatacttctgctgactgaagctcaggattttataatcactagggccaaaaattgtgccatatctttcttttcgttcaatagtatgtgtcctgtttgatggttattgtttcttttgaaagcaaatatgtaaaagtcttttatccctcatattttctttattttcttttttaaattcaaatggatataaatcccctcattataattttgatcccataataagatgcaactgattttttaatctacaggtttcaagattgcaagaacagttgcaagctgagagggatcttagagctgcattggaagtaggcttgagcatgtcttcaggacagctttccagttcacgtggcatggattccaaggtgatttgatatttttgtaaattttaatattcgttttcctttttgatggctttctcagtacacattctgtaaaaaatctgctattgtacagacaaaggctgagctggaggagattgcacttgctgaagctgatgtcgcccggttgaagcagaaggttgcagaactccatcatcaacttaatcagcaacgacagcatcactatggttcacttactgatgtgggtgatcgataccaacatgcccaaaatcatcctcaacagtgagtatgcagacctatgatatttgtaataataagaaagagaaggaatctacatatgaaaatttaagtattaactattacagcttttgatgtacttcaaaattcaaattggtgctagttccacatgaatttgacaccaaatccaatttaactagcaaagggtctactgacatatcccaacttcaaatggataagtacccactaaagttgacacacaaaatattggagttagagaaattttcctaaaaaaaggagatgaaatgttgtaatatttccaattttctctttttcgttgtatccataataaagggtggtttgtatgactgtatcctctgcatgtgtgtttgtactcattctatggtaatcattttaaagttttaacaataatttgctttttccagactcaaacactagtttgttgctgcatttctttaaagtttatgggaccagtttttaattgaaagccatgtgaacttgttaactcctttagtagttatttaagtctttttgacttgtgcaggaggtttcttcagcaagattttgattcaacccttgcctttgttaatcacgagaggaaacaaaggactgaggtatgtcttatagtctatttctcaaaatcaaaactaaaaggaaaaacaatcaggaagatggttgaatcttccctatgttagtccaatcctttcaactccttctgttagtattaaataattacatgagttgatacattattacacacaagttagttccataattaacctctaatcgagaaacatgtcaagttcttttctttgcttttattgtaaaacttattctcatcatgaccatgaaaaatgatatagaatggtggcacaaatcaggaatttttattactggattcatttctttagggtattagaatctaaaatgcttctgatccaaaattgtcactggttgcagcacgttcctctctaatttagggatctatcattttttatttgttttttttttatgataaaattagttcattacttatagatgatatcttcttttatggtttggactttggagcctcttcaacaaggtcggtaaaatttgccttttcatatatgcaggagagtttgttgggcactgattggagaaatatcaaaggacaagtattggcatctggtaatggtactagacagccttctcgaaagcaatttttagagtcaagtcctagcgattccaaaagtactgaggcatcaacaagcatgtctgtcgatgatctcggtgccgttgattcggcttctgtgccctccacctcaagagcagcagaggtaagaattaagttaaagaaatgtttcttggaattatgcataattctagtaacatctttttttcattgtcagatatcataattactttgctaatacatttttgcagcatctttatctgcttccaaataatttggaactaacctagttgcaatggtttcaggtgggggaatatgcaagacatccatctgtagcatcttcaacattagtagagttaactactcgtcttgactttttcaaggaacgacggtcccagttgatggaacagctccataaccttgatttgaattatggttctacaacttcccaagactttgtctataaaccgtcttcgccgtcgtggagttgactggccaaataataggtgcttcataaaatccgtggggaagaattttggctgacatgttgtatatcctttgagtctgacttattgcatatatttttatccttcatgggtctgtgtactgcttcattctcttggttcctatttaatttcttcttttggtagtgaagttcattgaagttgaaatgaaaggctttccttttggtcttcaggtctctctttttttaataacattgagttcttttgtttttttaggggagggggtggaatttggtgtaattatatggcatgtcaatagatggggaattttgttgaacaaacagctaaagtgaagaaatattaattaccgttttggcaaattctttgtacatagagacatgcaattgccagtttatgtcacctatgtggaatgattggtatgtatgttattgttatgtatctagctggttgtttgtgatgctaataatttttctttagtataacgctcagctttttactcctgtgtattctgactttcctaaaatcatctcaaaagcatggaaaacttagcatgttaggtggaaacgagtcttgttcgttttattttattgaattcgtttttaagatgggcatggctaacaatttgtatttattgggagatataaagttgatttagtgggagaagagaagagggagatgttgtaggtttgaatttttcttgctaacaaaaaataaaaaattaacaattaatactggcctttaaaaaaatattaatatttacccttaagtatttgtaaaaaggttgctcttttgtcgttgaaaccaatgcagcaattaatattaaaatagaacagtacaatttggtctagttcagttatttatttcacacatgtatagattttttttaaatttttttgatatgaatcactttatgatatttctttacattatgttattattgagataaaaaaatgctatattattgacagattattgactttggtatcagttaccttagagttaacaccggtgatttataattaaataataatataaaactattttatattattactattagtgcataattattaaaatttaatattattattattaagtgtattcaaatgttcaatagattaatcctgatgtacttcttgttatataactatagtattcaaccaacatctctttctttttattacattatatctcttattatatttatcacatttctatttaatttctttgtctctagtgttaatgaacacatcagtgttcacaaaactttaaattttttcaacgataaataaattggtttagaggtaatgctaagaataatttatattaccaaaagagtattctgaaaccactcaagatcaccatttgtatagacttgaagaattgaccataatagagacaaataaaatattgtataaatatgagttgttatatgaataacacaactcagcctaaaaagaaaacatacgcaattccaaagaaacaatagaagacatgggagtaaatgtaaaatatttagagtaaattacactgcagagttctaactatattgctgcaatgacatcaagtaatgtaaccattatactccttttacgggtttgaacaaaagccaccatgatacttggtggagacaactcccaaaggtgtctgattggaatagtcgcgtagatggaactaaccactccccattgccaccaagcattagaatcattaggagccaaacaagaagtaaagtgagaactgaaacctttttcctttgcaaatttctttccactaaatgactaccatgataaaatgataaccattttctaccatcaaaaagcgaactcaaatcagttagatatccatacgagtattttctttacattgacttacaaatgcagtcgctactagttacattatgttttcatatattcttgtgttacacaggcattcgcttgcctctatagcggtcaaacaactgcaaaaacacagaaaattagcaagctcagttggacaatttcatttacacagaagaagtatcactctacaatctctagacagatatatagaaccaacgattaatgtcagattcctcatcgagacccaccaggataatgttaaaaaaatgaacacaatgatgaaagttttataaaaaacatacatgcaaaaatggatcagccacctccacctcccaaaaaattcagaggactgtatggcttcatttgtagttcatcgtagcctcattgaaaaagtgaaaatgtttttaggcctaaacttacagctcttttttctaaattcagcatcataagactttagtttgacattcactaaacactgttgcttttcctctatacccaatatctcactatcattcacatctattaatgaaaatcaatattctccaatcaatcaaagtgagtaaagatttcttgataactttcatgaacaccaattattgataaggtagcacccagactggtaaatgtgtaagatacttttgtgaagacttagatgacaggttaacgcatttccattcatcacaaatacataccgatcgaacaaatggttgttgaaataaccaaccaagaacaggaatcttctgtaagaaaacagccagcgtgggccagaaaccactgcacagtataatccacaattagctttaagcatacagacatactcaaacacaacagatttctttcaaattgcaccaaacctgaatagtacgatgaatccgtaagcctcaacaatcatgcccaaaataggccatcccatgatgagaataaagaacccgacaccaaatgagattgttccctttaagaagagtaaaagtgagcagggaaaatttaccatgaagacagcatgatgcaccaagtgaaaagacatgtaacaagtttaccttgaaattacttcgtttcatgaagaattggatagtggattttagcccaatggttatggacactccagaaacaaacaggatctaatcatgcagataacaaggtataaaaaaagatgtattaagtaaaattaaatgagaagcaacttctataacaagtaactcatggacaaatcttacatttcccatggctagcaatcccttgtcaaagaagaagataattccaaggaatgaaaaaaatataccaaagccagttaatcctaatccaatctctgtatcatgtgccaatcaaatacattaaacatagcaataacaaaattgtagtagatataaaaaacgtaacgtagaaaaatagtacagtttagtcaaatcaatccttatgccagcaagtatgataccacaacataaagacactaatatatttcatgaaaaatctataatgttattactaggcaaactaataacatacatcttaaagatgtctttcccccaagaacctgaagaaaatcagcttgatggattggaataccattacttacaatgtgataagcaatgccattattggcggatttcaattagcatcattaggtgatgtcattacttttaaataaccaattttaagaaaaaaaatattcctataaaattgcaatcatattacttttgacaagagaattgggtaaaaaactacgtaccccatagcccggaggctctacgctatgcgcaggtaaggggaatagatattgtatgcagccttaccctttgcatatgcaaacagactgtttctagattcgaacccatgatcaacaagtcaccaagacacaactttaccgttgtgtcagggctcgccctctgacaagagaattgggtaattaacattaaattataaaaatggctaccctgtctaatatgtttatggaattatagctaacaccccaataatttattctcacacataagcattaaagacaacagatcacttcatataatatcattttcttgatataagaacaaaaatatcatattacacttactcttccgatcattcatctcaaaggaaaccattttgcaaacaattcagatattcaagcaccttgcccttgctgaaacacaattaaataaccaaactcggtcaataaatgagtgtgaatcatattctttatggacagtttaatttataggttatattgcaacactaccaccatgggaaatcttaatcaaagaaaagatcctgggacaaccaactgcaatgttcagctcccactgaacaaagcatgtgctaaactttaatttaaccgcccataaaatatcagtttttcaatcgaaatagttctcggatataaagctgcttgtgttcagagaaaagcacaggcaacagtataagtaacaaaagtttaaaatagtagaaaagcaatttgatgttttactgttatagcaattcaagtataacttgtaatagaagggcaactacgatgatccatgaagaaggtgtgcatataatgtacaactgtcaaaccaaaaattcgagtcattctgaaagcccacatcagttagtcaacttgaacaattgataccaacaacattcttctctaatcaataaattatgcaagaatagtcttgagtttttccaaattttggaaccccactatgtattaacaactgataaccagctttttctttaactaaattgctcattttccactcctttagcctaaaggcaaaacgcaagtcaagaaagaaatgaagaccaaacataaattttatctgcacacatttcaagtatagcattctaatgaccaaatagtcaatacctaatccagggctcaaaaattgaaggctatttcgctacaccctttactcacactcacaccttaacctaccccaataatacttacaggatcaaaacccaagccatagaaaccagaaagtctccacaaaaactaatacagtaataactactaagcactagatctattaagctattcaaaattaatctaaagcatcacatacattcaatattcactacaagtgttgcataaggtacggtcaaaatcacattaaaaaaatggaaaacagatgcaaataaataataatcataataataacaattagaaagctaaaattactaaacccaaaaagaaatttgcacatatactagtcatatagccacttttacttctacataaatattttcgagctttctcgaattttgaataatcaaatttccgtagaataacgattgagaacacggattcgcagcgcaattaacaattatcctcctcggtgggtggctaagcattttaacaacgattgagaaagtattcaacgcctctacttcagcgacacctctgatgaaaacgaagttacgtagtgctgctactgctatgaattctggtgaagaaaatccttcgaaattgaatgtgaatttgaaccgagcgattcagagaaagagagcgttcgggatttgaaaaacgaaagcgtagtgaaagagaactgaagtgaagcgatgggatctcacatctttggtttcagtaacagaaacaaatcgatccaaaatcataaacagaaaaaaataaattaaaatgcacgttcactcgttcggggagaggtagagaggtcaccggtgtcgggagcgaggcgtcgccggaattagttggaaatggtcgccggacgtggtcgtgccgtggtggtgttgaataagaaagattctcaattctcaaatgcaaaatattttttggtcagaaaaataaaataaaaatacaaaaaattgcattgataatataaaatttataaatcgtcagaactcggcccaatgttaatctaaccatgtacgggttttgaaagttcaaaatctcggcctaacatatgaatatcagccctccaaaattgcttttagcccatagcatgaatgcttctttcctaaccaaattatgattttgtttttgttatataaattgatacataatggaagtataattttattgtgtaataatttatatagcaaaattatatttttattgtactttttttcagaaaaaataatgtataatgaaaatttaattatattatataatgtagaatgaaattatatttttgttatactttcttaattaattttcacttgtataataaaatcgtgattcacctaaactagtagaagtgcgaaaaaaagagtaaaaaaaacacaattgtgagaaatgatatttttggaatttgaaaatattggtaaggaccactaacaatccctaagtgttacaccatggaggcaagagtgtctcaatttagtcttgagactaaaaacgtgaagagacttttaataacaacttttactacttaacagttttcttctattttatttatactaaaatgaaactttgaaaatatatatatacaaaacttatattattatcataataagactagcaaaattagaaaaatcataaaaaaaataaaccaccagtatttaaaattataatagtatttgaaggtatgagaaatatggtgtgccttgtggacttcctataccttattttcttaaactttcatttgacaaaaaaaaaagttacaatagtgtctttcttttgtcaaaaataaattatatgttgcattacattacattaacaaacgtttttttataaccatatattataaatttataacaacttatacatactatttaatcaactaagttaaattctcttaatgcttcaattgagttatatattctacactattacacacaattttttttaaaaaaatatagtgaaaatcacaggtgattttcccttttccaattcttttattgcgttatcaaaccttcctctcccgttttttcaatgcgttcatccttcattgttattgtgttgcttattcgcataaacatattgtatcgttattgaattcaatttcatggatctggtgttgtttcttcctatatagaattccatgcaactgctttatcagtgggaaactgatggaaagttgtttttggaattgaatcatttggtacatttaattttggttttcgactctgattgtgtgtgtttagagctcaatgctcaacttgatgtttggaatcgtatttgattaagtagagttttcacccaagctttattttgaattttttatcgcttagttgttaatccctcattaagggggtcaaattggaataactcttgttttattgaattctagctttgaatttcacttttaatgggtaatgtggcgcattttggtgccataatagccatattattttttagagtaaattacactcgcacttcgatattttttcttatacttgataactcttcttttttacaccctataaaaacatcatgttacttgatatctcctaaacattatttaataatttaatagaaaatagacacatgttagtcatatgacttttaatgaaaatttatgtctaaaacatccttatcttcttcctcaaaatcacatcttgaattttacaaaccctcattttcttcaacgacccctcttcacttaccgccaccacctccttctcctcctcctccccctcccacggcatcatcatctctttctcttcattgtcgtcctcgcccaacaacacggtgtccaggtacacccactcttgctggaacaaccaccaccaccgtagttaccgtcatatccacttccatcacctcctcgtctcccgccgtagctatggctaccatcaccgctgggtctgattccctagaaattggcgttagttaacaatattatcagaatgtggtaaaagtaatgtattaaaagggaggggtatcggatgcaatttgagaaaaaacataagggatgcaagtgtaaattaatataacggtcaatttcatcttctcaaatgtttcaattgaaattatttaacaacattaataaaaagggataaaagtaatatataaaaagagaggggtatgggatgcaatctgggaaaaacaccggagctgcgggtgtaatttactctcctttttatctcaattacttgaaatctgactctttaaactgagctattttgtttcattttttgtttgtaggttttatgtagctagagtttagtccctctggtagagatggataaagtgtctgctccttcctcacaggagcgtgcacaacgcctttatgagaaggtacacctctctctctctctctcataattatcacggatgttattactggaaaagagcttatccatgtgaatctctcgtaatctgccaaatgttaaggaatctggttaaccttaattaactcaattgtactcttggtacagtgtatctgcatatagaagtttcactttggaggacatttattggtgttcattgatccttttagactttagaggtttgggtttgattaattggtgttattgttcttcctctaatgggaagataaccccactttgcagggttgggtttgctctctttactatgacattgtttggaattattgctggaccttgttattagtaccttctggtgtatactattattgccaagaaatgctgcatgcttggtgttttggccctttgatttaaggtagcctctggcaattggcatacagccttacactggttagtaagtgcttgtcttgttcttgagttgtaaattaagaacccataagttgctgttgtctgtcatggcaaaccatgtagaacgcataacctgtggttttttgcgtgctgaggcttacttgttcttctgattaacttgataagattttttctttcttttctgtggaatgaatacaaaagatatatttttaatctcaatatttttctcacttagaaccttgaattggagaataagcgaaggagatctgctcaggcacaggtcccatcagatccaaatgcttggcagcagattcgtgagaattatgaagcaataattcttgaggatcatgctttttctgagcagcacaatattgagtatgctctgtggcaattgcattataagcggattgaggaattgagggcatactttaatgctgctcatgcttctgtaagctcaaaatcatctcagggagggaaaggtcctgttcgacctgactggataactaaaataaggctgcagtttaagactttcctttcagaagcaactggattttaccatgatctgattatgaaaatcagagcaaagtatgggcttccacttggttactctgaggactcggagaataaaattgtcacagagaaggatggaaaaaaatcttctgagatgaagaaaggtttaatttcttgtcatcggtgtttgatatacttaggtgatctttcacgctacaaaggcttatatggtgaaggtgactcgataaagcgtgagtttgcagcagcttctagttactatttacaacctgcagctatttagccttcaagcggaaatccccatcatcaggtttttggcattcctgtctctcatgtgctttgcttttggttgttcacatttgttgttgatcacggtttgtagctattgtattccattttgacaagtctgttattttcagcttgctttgttggcttcatattctggggatgagctggcagctatttattgttattttcggagtttggctgtggatagtccatttacaactgccagggataatttgatagttgcatttgagaagcagagaaggtaatatgaacatggggatgaactggcagctgtttattgttattttcagagtttgactgtggatagtccatttacaactgccagggataatttgatagtttggcatttttttcatctagaagtctcaattgtttgagatgtatcttgtttttgtttttttatgtgtttttgcttacttccaaactttaagtatgatgtttcaagttcagtcttttctgctacttgtagtgtttggtactcaaagctaaatgcattggaagtttataagttgtaaatttctcactggcttgcaagttattcaaggattgagacgtgtaacgtggagtttgtgtatggcattataagtatgcaattatatttgatattattgaaaactgcaacccagcataccttttcacataaaggagttctgtttatttggcatggttgggggtgaagaattagctcttgagctagatcctctgtttattttcatactgtggtgtgtgttgttgactcttccccttttgtcatatatatgatctttttggcattacttctaactatctattttataataccatgatagaatcgtcaaagttgctctcagctttctggtgatgttaaagttcttgcagtcaatgtaagaggaaaaggggaagcaaaactcatgaccagggatactggtgtggaaacctctcttagaaagggaggagcatccaatatacaggacacttacaaatccttctgcacgggccttgtccgtctaaaatggaatcttattcactcgtacaaggtatatatattaatgcacaaattctatctgaccatcatatgcataaaactattaaggattattatattctgacttttttccttttctttgtttctcatatattgtgatgatagccttgagaccctcactgaagttctctctcttgttagcgctgccctgcgtgagcttctatcatcagggcaagacgaagagctgaattttggcacagatacacttgagaacaaacttgccattgtcagagttgtttccactatcatatttacagttcatgatgtgaataaggaatctgaaggtcaaacatatgcagaaattgtacagcgtgctgttctacttcagaatgcattcaccgcagctttcgaattggaatacaattataaacggtcaacaaagcaagctgaaaataacagacttgtcaaacaatgagagaccgtttaatcctaaattataaatcacatggaaagaaaaagactttgacatgctgtatgtgtattttacgaaaaagataatatggaataattatagtgtctttggattttggctttaaaattatgaataaacataatgagatgagttaatcttgattttatctaaaacttgttaaatggttcatgactcgcaccgtagtaattttacacttttatataatattataactttttaagataacatttatttatttttattatcattataataaatatttatgacactttaacaaaaccatgataataaaaaaattacaataattattacaaaaacatatcagtgttaattaaattataatccattaattagtaaaagatataaattataagatgaaaacatcctgagttttaaaatcaatactatctggattaattagggtcggttcaaatcaaacttctgaatgtcatattactatcaaagatctaattacctgttttttctaattgtatgtgcctgtttgttcttccatttctccgtatagattacgaatattacagtagaacatgagtagcaatatagagaaaaataaatgcaaactaactaaatgataggataaaacaaaacaagagagatcaaatttaaggtattgtgtttgtttgaggaagatattagcacacgaggttgcaatcagtattagaaaaatcatcttcaaattggacgattcaactactgaactggtcaactaacatgtctgaatgtctgatcagtaggctactggatcgatttgcaattggtcaatagactatcttttagtttctttctattcacaaactcttttttagcttagcaaaacttgaaactaattctttaaaactaattttggtttagttaggttcacaggaacaatttggtgcaatctctctatttttggttcagagctccaaaacagttcaatttgattcagagcctaaagctcaaaacccaagtatgaaagtaaattatatgcacttgtgtaaattttccatgcctttctttaatttgctgacataaggggattagagcttatcattagcaaaaatgggttcactacaagaaaaaatgatatatgcttaagacttttgcctacaaacataaattattatagataaaagtcaaaaagattatatttatgaacacttttgcctacacatatattttatagtaagtaaagctaaaaaatacttttacctataaatatttagggtaagtaaaatcttgtattaatataataaatatataaaattaaaaaatacttctacttacaaacatttagtataggtaaaacttaaaaaatcttgtgcctacaattattcgatgtaggtaaaattcttaaaggtttctgcctacaaacatttcgtttaagtaaaattttaaacaacttatacctacaactgcatgatgtaactaaaactcataaagatttctacttacaaatattgggcgtaggtaaaacctttataattaaatttactataaatttaaaatatattttatacatttaaaaatatttatttagtatgaattatagttatataaaatagtatttatagaaaatttatttcaaaaagataaaaagatagaaaaataataacatcataatttatttcaaaaaataataaaaaaacttaaataaatgtattaatgataaaaagtgaaaaatataaaaattagaaattaaaagctaaaaattacttgaaataacaatttaacaagaagttacttaaaaattatttattaaaaagtcaaataaattagtaaaaaaaataaaaaatttgttaaaatgtcttgtaaaaaacaatatatatcaactaataaattcctttaaaaattatactccttaaaacccttcttcattgttgcaactccacgcgccagatctgcaaccattaagttatgctccagcaccactacgcattgtttattctcagcaccaacggacaggtgccgacggcggagccgccaccgcggaggacagcagaggcatgagaaagttttgttgattttctgtttctaaaaagatatttcataaagatagaaataaaagaaatatgaagatttagatatttagtttatatcttttattccatacaaataagaatatttagatattcattctatatctttttaggaaaactgtttctatatgtggtccatttattgaccatgtttatccactaacccattatcttttcccattcaaaattgaattctatgatggacaaaactctataaatagaactggacactctcttttttagatcaccaagtctaatcgagtttgagtgagtgagatactggaaaactaaaactctgaaggttacttgaaagttgatagcaatggctggaggtagatacctctaaaatttatttttctattttcgctttcgctatatgatttgaatgtgttgtttatgtttgttaacatgttcagatcaatataaatgttttacaagtttatgtcacgacactcgcatataagtatgaactcaaagattcacctggttttaggtattgaatttttggagtttcgattctgaataattgaatggtccattgatttgattcaattatggttggaattgaaaatatgatttcaattttcacgtgtgttacttgactgtgtagttcctattggcgtgtgcggaattcagcactagttcattggttctgattccgcttgtgattgttcctgccatgggaggcactcatgtgtgttgttttcgtgtggcttagttgttgtttttcgtgttgtgttgtgattgaaatttggaacaaagacagctgataatattttttttttttatcaaattgaagaaattcaagcatttaatgagggagctccagggggctatagttattggctcagctttcgaaactttacttgggtatacgggacttacttggctatagttattgtttgcacctttcaatttagattcctaagcaaatcacaccttaaaagtttaaaattatataatcagcttacgaaacttttgaaaaaatcgttaaaatttcatagacttaatacgcgacttgcattcataccaaaagtcaagtggtagaaacatattccttgaaatccgttttgggttacaaccagagccagattacccttcttggtgttgccaatgatattggtgagaatgttggcattcttccaggactagcctgcaacaagttattattcgagaaaacaaaggcattatgcaggaccaggacttgttattcgagaataattgtagtatgagtatcaaacattttcaaatttgtgtgaaattgagaatccttgtttttttatttatttatttattattattattattattattattattattattattattattattcctttattcatatttgttttcattgtattatttgattcatttagtaattaatggctattaatagtattgtttgttaagctgtacatggagttgaaagggcctagttaattatcacatctttctatctatggtgttgcagctatggtttgattttccacactttaaccaaaattgatatgatatgttaattttaactgagcaaacattttggttaattttaactgagcaaaataaaaagtctgtgcccctatcttacgattccgaacttacataaatttggaatccaaattataatttgttgtttccataataattccaaaagtttggtaaatgatatgatatgagcacctttacgttttgatatatatagcatacaatattccaggttttcttgcacagtacacaattttgttcacgaggcttttcctccttatatttttaacacaaaaattaaagttaacttcattttatcattttctctaagtagccaataaaaataagttaatcactttcttatccgacctcacttggtatgttgcaggaagtctgaaaaatcacttttatttaaaatgtgtccaatatctttaaatttatttatttatttaaattatttaccttagttaaaatgtttcaagttctcaattacttgaataaagacgtgtgaattattcgtctatactcactccatggacttcaccttctgtgcaatttgcccgtgcttgctgtttgaattgccaatatggtaagcaaaggaattgcagtgtacaatcacaagggccataagatgtggcaacgtccagaaaataacactattgcctagtgttctgctcggagagaacagaaatgtccaacaatggaattggatgtttttatgtaggatcaactctctctctctcccaagaagcttatgcaggcgaagcaacttgaggaagaagatcacacggaggaacacggcacaatgggggggtgctgtgtgtgcaggtgtgaagggaaaaagagagagttcagagtgagtgtgtacctttcaccattaaacgcatgtatttataagatacctgggttctgttcgtcgaaaccgttgaaactgaagcggggctcctatatatgcggagatattggctcgtgggggataacggccacaccccaccttccggggtggttatcgtgggccggtagcggttgtttgacccattcaaacaagaagataacaggttcatcattcatccgtaacagatgcccctcagcccggtcgtctagcattctggatggccgggatgtattaataaggaagttgattgtctctgacatccgagccgagcttcacttgacgtccgagcaagccctcgaatttgttcgagctgatatgttttcctatccgtgccgaggttttgtccctccgaaccgagggtactgaaatgtgggccgatgtgcgttgccccttgcggatacaatccatcatctgatcaaatctgtcaactttttcttgtcgatttcctgtcttttcatagccgcccggacaactactagtatgcgtagaggggtgcctacaagcatagggaaatggaacgtcccggttcccttggccgccacgtgttcctttcagtctgttttatctccttcaatcatttcttttcccttgctaatgacgtttttgcccttttcatgatttttgtgaccagcagttattactcatcatttttgaattctggcggttacgcttcgcgttttaatgcgccctttcagtttcattctttctttattgaagcaattatttcgttctcccttccatacttttggcattcttcttggcattcttcttgttcgtgctttctctgctgcagattcctcatacccatttctcctttcgacttccattgctgcaactcgcgttcctcgtgctttctccttcattctcctttcatcctcttcgcttatttcaggtatccttctgcttagctttttcctttatcgcttcagtcttttgttgttttctgcgttttgttcatcttatttgattctgcacagaccttgaatatcgacttctgtctcacatttcccaatcctctattctgttcttcattactacccctagccatgaaatatacccctgagcaagaggcggagattcgtaaatcctgctctcctcgcgctgccttttggctttatggtttgccccttcctgaagaggaaaagaaaaagtccctacttagggctccttctgccccaggaagttccaaagcttccctttcaagaccccccaatccttccagattagggccttctaggttaggatcttctagtttagggtcctcatctcgccaaagaccagcactcctagccttgcaagcgggggcgtctactagggtttcccctccttcaggtattgcctctccaaatgaatccgaaacttacccgatacccgaaccggattcagagattcggtatgagccctgcccaaattgtatagaggaattcatatatctagccagtatagaccatgataggcgagccgagggagtattagatcgatgtcgtcataaccccgtctgggttcgtaagcctgttcctaaagaaaccaatacccctccagcccgaccgggcaacaataccacttggccgacctccgttgaaaggccggcttcaattgaaggatctatcttgccgacttcgacttctccttcctgctccgcgacggtccttacaggtacttgaactaatacttgtttttattgttataggtaacaatggactcatctcggtccagaactgtccgggggtctgcaaccgggcctcgatctcaaactcctcctcctgctctaacaggtaggtttccttgggtaacccatgaggtgttgcaacacacctcaacaatggattccggggacctcgctttgattcccttcggggctcaggagggcttccatgtctgcctcccccttccgggcgaaccgatttgttcttctcgagaggggaatgaccctgacttctttttgttctacaaagatgtcattactcggttgggagtttgttttccctttaccgacttccaaatgcaagtgttgcatcacctgcacgttgccccctctcaaattcatcccaatagctgggccttcatgcaagcctttgaagtcctttgccaaaagctacagctcccttgcacttgccccttattcttttatttcttcacggttcaaactagtcggtcgggcaaggagcctgctgaccggaagggatggacctcctttcgaggtcgggtcgaccgtcactttgatcgtcgactcttttccctgtatgctgagtcctttaagggttttaaggacaagttttttaaagttgtagccgaacccggccaacatccattcttttctaactcagctgattcttcttctgggccttggaaatttcctttgtattggtcctcggcccatcatgaccttccttctgcttcataccgaaccgacgagaccctgttgtcggattctgacgccacttctgctgcccgaataatttcgtacaaagagtcgggaaacgtggcccccatatcttattatattcagtgtggtcagttcgaattgaattcttttcgagaataagtctgaatacttgtcataatttgaaggcccgtgatttatttttgctaacgcttttgttttgcgcagctaccgagatgaacacaagccgtgcccctctgccggcgcaccttgaagctcttaggtttaggaggaagcgaaagcggccaacagacaaccagcaggtggctggcgaagcacgaccggcgcctcccatggttgaatcctccgtgtcggtcgaatctcctgatttggccgaaccaaccactgggactccttcagctgatcttcccccctccccggtggccgaggtagccgctgagattcgtgatgagccggtgacggatgccccggctattgctgatgttgctacgatgcccggtccttctgacgagcacctccatatatcccctcgaactctttgggaccaaggggtgactcgggaacttttccaggctctcagggcgcccaaaagatattccgagctgctcccgttcagcgactctgacaaggaggagctgggttccttggagttggcctgtcacaagaccgcttccttgcttgggaacttggtggccttaaacaagagggcctgcacagcggccgccgacctcgaggcctccgaaggtgaagtgcgtcggcttcagcaggagctagggtcctccctggaacgggtcgctgctgccgccaaagaagtggaggtgtctcaagcagaagccagggaggctcgggagttggcaaccaagctgacggccgatcttgaggcagttcgggcacagctggactcttctcatgcggagctcggggcttctcgggcggagactgaagccgctcatgccgaggcagccaaatacaaggagtcagctgctgcatacaagcgtcgggccgccgacgccgttgcgcgccagaaggatttgatggacttcaatcagaagaagattaaggatgcggaggaggcctataaggagctgaattttgttcagtctcagcttgctaagtctttcgaggcgtccttcaataatgctctggctcagatccgcttcctcaaccccggtgtgcagctgaacaccgagggaatgcatttcaagtcttacattggtgatggtcaacttctggccatgtctgatagcgaagaggaagaaccgagcgcggcggatccgcctgagggggtgcctggtcaagacggcgtagaagcttgaagggccgggatgccggttgcatcttttgtattttcttttactgttatgtatcttcaaaacaatttcttctcgtttcgtaatgacatccacctgtttttataatttcgcttttctcgtgcattggttccaacggccaagtatgtttgactcgtcggtcgatttatcgtcggcttatatagccaactacttaacccgaatcggtattaagtagaatgtgtgggtctagttcccaatcttagcaactgttaatatattcgtaagtattaatcggtagatgtaattctttcagaaattctgacgattcaccatgattgaataattacgccggcctgatcaggaccgagttaatataaaacaacgactgagcgctcataactcgtgcacgaagatatgccttgtatcaaggattttattaattcatggtatcaattacagatttgcgcgggtgtatgttcccggttcacataatcaattgacaaaagcatgaaaagttacatagtttttgacctcaaagtagaattgtgcgggtgttggttcccggttaacaatctagtgagaattgttgtgacctcaaaatagaattgcgcgggtgtatgttcccggttcacaaaatctaatgaaaatcactgatcccatgatcccaatgacgggccctaaggccaactaaagggaaacacatggtgtccatgattccgatgacgaacttgtagccgactaaggggaaacacatggtggggttccatgatccccatgaccgactagaagtcaattaaaggaaaacacatggatcttatctgcacattgtcagctatagtacttcttcaatttgtccgcattccaagttcgctggactcgcttgccgttcaatgtttccagtaggtaggctccttgtccaagattttggacgactcggtacggtccttcccaattgaccgctagctttccatctcgggcatttttgtttccgatatctgctcggcgtaacacgaggtcgtccttttcaaaggacctcggcttgactttcctgttaaacctgtgggccagcttgcgtttttgatggagatcccgacggtgggcggcggtgcggacttcttctatcaaatccagctcggtagttaaggcggcattgttgtctccctcttgtgctatgtgctgctttctccatgatgagtggccgatctctacagggatcatggcttcacaaccataagtcattctgaacggggtctcaccagtggctgtttgggccgttgttctgtaagcccaaagtacataataaagttgctcaacccagttcgggccggctttatgcactcttttctttagtccttcaaggatgactttgttggccgcttctgcttggccgttggactggggatgttctactgaggcgaaatgatgtttaatatgaaggccggtcatcatggcttggaatgttttgtcggtaaactgcgtcccattgtcggtgacgatttccgctgggattccgaatcttgctattatggtccgttccaagaatttttgaacgcgagctgaggtgatggaggacaatggctcggcttcaatccatttggtgaaatagtcaacggctactattagccatcgcatttgaccctctgtagctttaaatggccccaacaagtccatgccccatttgtaaaatggccatggtgcagtgatcagactgagctcggaaggggggatccacactattttggcatgtctctggcaggtatcacattttttgacatgttctaccgcgtcggctttcatcgtcggccaaaaatatcctgctcggagaactttcagtgccaaagccctggcccccatatgttgcccgttgattccttcatgtacttctgagagcacatattcggattggtccgagttcagacacaataatagtggactatgtaggcctcggcggtatagttcgtcgtcgaggattacatacatagccgcttcccgaatcagcctctttgcttctagttcttcgtccgggatgatcccttgctctaagtagttgatgatgggtcttctccagtcgtcggtagtgagtatgagcattacacatgccggttgggcgagctcttgttggatgactgacctatggtttcccgccccctttgtactagccaactttgataggatgtcggctcgggcattttcttctcttggaatgtgggcgactattacttcatcgaattctgccatcatttcctttactttagtcagatatttggctagcaacggacccctagtctgatatctgacctcgatttgtgcggaaaccagctgtgagtcggtgaagatgttgacccttgttgctccttgttctttgacctgcttcagtcctgcaatcagggcttcgtactccgcttggttgttagaagtcggaaagttgagctggagcgactgttcaagggatactccgtcgggattttcgacaatgaccccgactccacttccttttgcattggatgagtcgtcaacatatactttccaaattttacccttctgctgaatggccgacgttggagtcaattctatgatgaagtcggccaaggcttgcgacttaatggcatggcgggcttcatattggatgtcgaattcggacaactggatggcccagttcatcatccgcccagctaaattcggcttgtgtaatacttgtcgaatgggttgattggttcggacgatgacagtatggctctggaaatacgggcggagtctctttgccgtggtgaccaaagcgaaggccaccttttccagcttttggtatcttagttccgcgtttttgagagctcggcttacaaagtgtaccgggcgttgaattttgtccacctctctgaccaagacggcgctgattgcctcttcaccgaccgagaggtataagatgagcgtttcccccgggtccggttttgataggaccgggggtgaagccagacatgcctttatttgctgaaacgccttttcacatgctgaattccatccaatcttggcttccttttttaacaacttaaagaatgggagagccttttctacggatcttgggaggaaccgagttagggccgccattcttcccgtcagttgttgcacctctttcttgctagtcggaaattgcatgtccaggacggccttgcatttatcggggtttgcttcgattccccggtgggtcaacataaaccctaagaactttccggctttgaccccaaatgcacatttcaacgggttcagccgtatactatgttgccgcagcttttggaaagtttcttctaggtcctggatgtggtccccggtcgtggacgtctttgtgatcatatcatcgatgtatacttcaatgttacgtccgatttaatccgagaagactttgttcatcattctttgataagtcgcccctgcatttttcagaccaaaaggcataacctcatagcaatagttagcgtcaatacctcggaatgccgttttctctctgtcatcggggtgcatgggtatttggttatatcctgaataagcgtccatgaaagacagcagctgaaagcctgccgagttatctacaagctgatcaatgctcggcatgggatacgagtctttgggacagactttattcaggtcggtatagtcaacgcaaactcgccatttcccgttggacttctttaccatcaccacgttggagagccaggttgtgtattggatttctttgataaatccagcctccaatagttcttcaatatgcttggtcaacgcctgtcgtctttctgggccgatcttcctgtttttctgctctacaggcttagatccggggtatattgccagcttgtggcagcagaaggtaggctcgatccctggtatctcggatgctttccaagcgaagacatcttgattcgtcttcaggcattggatgagtctgcttttgttttccgggtcgccttgcttgcctatcttggtgacttgtcccggggaaacgccgatctggatgtcttcaagttcgtccgccggctcgggtctccattcctccacatctcgcatgtcgagttctaccaaattgatcggtttccgggatatctgttcttcggtcctggattctcttagctctccttgccgaattcgaggtggtgaggacgggccgccttctgtttccctgatcgtgttatagtaacactgccgagattctttctgatctccacagatcatgatgacctggccgaggtgtcctaccatcttcattttctgatgcttcgtggacatcaggatatcccatttatgaagtgtaggtcgccccaagataatattgtatggtgacgggaattctccgacggtgaacgttaccttttccgatctgaagccctctctcgttcctagcgttagctggaggtcgatcactccctttaggccggtaccttcaccgttgaaaccatatagcatggtctgacatggcctcaggtcttcctccttcaagttcagctttttgaaagcgctccaattcatgatgtcggccgaactgccgttgtcaacgaatatacgtttaactcgaaaattggcaacagttcctgttatgacaaggccatcctcatgtccgggcaccactcccttcaaatcttcgtcggaaaaataaatcaccgggggtgcgtcctgtttactatttctgccgccggtttctttgaactttggtcggtctctcaccgacataacctccttgaggtatttcttccgttgattgaacgtatcgcctcctcctcctagtcctcctgcgatgacattgcattcgaactcgggttctgggaactcatcgtccttcttacttttcttgtcatcgcgtggtttattctcctgttgagctttcctcttggcttggtgcccctgggttcgaattacgtattggcggagcttgccttcacgcacgaatctctctatagcgtctcggagttcccagcactggtcggtcgtatgtcccggtccattgtgaaaatcacaataccgggtatagtccatcccttccttccgtactactggaggaggtcgggtcacttttctcatctctgtgaaggccacctccttccagatttgtccccggctagcgctcaatggagtgtatctttcaaacttcgattcatatttccctgatctaggacggttgtcgaggaatcctcgtggaggtcggcctgttgggagagtggccggatgtcggctactttgtccgacttggaagttttctggtcgtcggtttctcggagacgtcggttttttattatcttttggagccgagttggcaatctccatctgcttcagctccagatattttttggatcggatgccgaactcgttaagggatttaaccgggtctttgtatattgacttggcaagtcgggaggatccgttgagcccggccgacaagagatagacatggacgttctcttccagcccgtggacctgcagtgcggcttctctaaatcgatctaaatagctttgcaatgtttccccgttctgttgacgtatccttcccagagcgaactcggatttcggctgcttcttgcttgttgcaaagttgagcaagaacttctggccaaaatcttcgaaatttcgaatggaccttggcggcaacgagtggaaccaagtctgggcggctccggtcagggtcgttgcgaaaatctgagatataatcggttcatcaatcccccgcacgcacatctgcatatcaaattcgtcgatatgtacttgtggatcttgactcccattatatttattcaggaaagacccatcaaagtcttccagaaacggggcgttcactatgtggtcaacgaacgggctattattttggtggccccggctatattttctcctatatatgccattgccttgtccgggatggcgggcgacttctcccgtcggtctctcccccgcggtgtgtgaaatggccgtggatgaatgatgaacctcgtgctgtggtcgaggtgtttttccctgttcggaatggtcgacaggctctagttgatcggttcttgctactcgggtcgacatcgatggtcccgaccttcttgctgtgcatggtcggcttctgtacgaactccgtcacgcctatcgtcggtattttgccgacgctctgcttcacgtcttctgtcgtcacgatcccccaactgagcgatcagctgttggatgtcttcctggcgttgtaattcgtaacgcttctccagattctccattcgagccaacagggattggagggcgctctggatgaaacgttgagaattttcttgctcggccggtggtgtgttggccggcacttgcgttacaggttccgcacgagatgatgatgtgtgggacaacgcatcttctgctaccacctcctccggagtcggattcctgggtgggtcttcacgtctggtattcggatttcttctaccgttagccattgatagatggtgggaatcgaattttatcgtttcccacagacggcgccactgttctgctcggagagaacagaaatgtccaacaatggagttggatgtttttatgtaggatcaactctctctctctctcaagaagcttatgcaggcgaagcaacttgaggaagaatatcacacggaggaacacggcacaatgggggggtgctgtgtgtgcaggtgtgaagggaaaaagagagagttcagagtgagtgtgtacctttcaccattaaacgcatgtatttataagatacctgggttctgttcgtcgaaaccgttgaaactgaagcgggactcctatatatgcggagatattggctcgtgggggataacggccacaccccaccttccggggtggttatcgtgggccggtagcggttgtttgacccattcaaacaagaagataacaggttcatcattcatccgtaacacctagtatcatgttgcctggtcagaatctggctaagtctaaaagatttttgtcgtccgaggaattgaagtttagctaaataagagaaattgaatcacataattaagacgaccaagagattatcttagggtggaatcaagggaatttcaacacctaatcatttttattaattgatttttctagtacattattcaattgtgctcttgtttctttcaattacatataaaaaaaattcaaaaattcctaattgtttatctcttaaatcaaaagagtaatcgataatttgattgatgtattttgataaaccaaattttttattgatacaataatttctccttattttatcaattgtacaactagtacactacactagtcgtaattctcaacaaactacaacaatatgctggtagaaggtgactcagttgatctttaagtcactttacgtgaagtccacattgcccacagtaggattagtgttagaaaacattactagttcagagtaaatctttcaatttaatttccatagaactaaacatgatggaaataaagttagtagaaccgtagatatatagatgacacaatttgtttgatgttaattaatgtaaatgtactttctattgatattcaataaatttgcatgttgtcatcgttcaaaaataaaaagataaactattttctaaatttatctttttagtttttgaatttttatttattttttaatcacttaattttttagtatatattacatttttgtttgcttggaactataataacatgcatatccgtagagagagtctcacaattgatttttaaggcagcatgacacttcacgacaggttcattccattgctcaaagttggattagtgctacagttaagagggaaagccttaggcttctactaaactgaactccaagaaaaaataataagatgaaaaggatgtattatttagatgaatagaaataaaaaggaaaaaaatgtaaattttaattagtttgaataaataagagagtagaaaaccaaaatatggtcattgcaaaaatgttcatcaaataaaaaatcaaatttaatttgaaaaacctgaactttttatttaattatttctcaacataaaaatatatgttttgttataaaacaataatttaattttttaaaatttaaacataagtaaaagaaaactgctaaccatttctccctccatttcatgtgtgttagtgagaaatatggtttggttaggactcattaattacaatttcatttctcattttttaacacattcaatcaagactatttttttttatcacttttttctcttcattttaattttgttgtatatagtaattcttttcaaatcgagtaggattaagtctcagtgaaagatgaatgcgtaataaaaaaagcttttactgtgttatgatttgctcccttcaccaacaacatggaaggaaggggaaaagctttgaggtgggttatgcagtatagtctcaaattaaggcgggaacaataagaaaggtaatatttcatgacatagaaaatgtagaataatctcaaatttaaacacaagcttcattgttccacaaacaaataataatacagtgccttaaagttatgccaatgtctgtaattctgtaataagtttagtcctgtttggacaaacgataatatctagaccacaattgtttgtcgaaaaagttaaattgaaagagaagaaacagaagtattgggaaaacccccattgaagccactacataagaaacccacttggaagtgtgatcaaatatcaaaaaggaggctgcagtgaaatccacaaccatagcagcaacagagataaaaagtaaccaacgcccaaaagtcaagctgggatgtagtgatatcacaaattcgctttgtgcgaatcttgatgaagtgaaatttgacaagaatgagagtaaagacgcagaagaagcgaataatgcgactgcatttgtcaatatgacgacagtaaaccacgcatcggtcttatcacctggaacagtcagagcagctgcaaatgctacggtagcaacaagtgttgacacaagcatgcctgaatcggctattcctttggctgcatccttaatttcttgggataacttcttgtgttcatcacaaaatacatcaattggtgtcttgtccatgttgtttctcattgttcttagttcacgaggaacattcgactccacgaactatttaaaaatcaagagtatatgtaaatgatggtatccaaatgcaaaacttaattaatctttccgttatcacttaataactaagcagattacagcaatatctcctaaaatttaatgtaattacacaaacatttactgagatattagcttaaaatttgaggaaatgtgaatttaatatttttaaacatataaaaaatgttaatgtaattttttaatcctcaaaaaggagttagtataagaaaaaaaatggaattacatataattacacgaaacttaaggagaattactgtaatttgctctaataactattagatattaaatttgtaagaaatacaatttaaaagataagatattttaaaaataaatcttacgggtgatatttattgttacaaatgtacgtgtataatttttaattaaaatatattggctgtttaactattatgctaaagacaatggataacaaattttaaaaaattattacaataatcaacaaattctgcatacaatgatttctatttttaattaaaacatgttacttttaaagatttaaatcagtctagttaataaaagcctaaaatttgtggaatcttttaactatcacctaataactagagcaaattacaacgccactttatgaggtttagtaaggtttgagggaatgttaatgtaatgttttcaatatatgagatgttagtgtaatttttcaaatttaaaagaagttagtgtaaacttaaaagaagttagcgtaggaaaataaaaaaataaaattatatataattacacgaaacctcaatgaattattgtaatttgctttaataactattacatattaaattttaagaaatacaatttcaaagttaagatattttaaaaataaatcttgcgggtgatacttgttgttacaaatgcacttctataatttttaattaaaattttctatcgatctatatattgcctgtttaactattatgcatgctaaagacaatataatggataacaaattttaaaaatttgtcaaaataataaacaaatactacatacaatgatttctatttttaattaaaacttgttacttttaaggatttaaaattggtctagttaacaaaagcctaaaatgtgtggaatttttaaatttttaaaataagattgctagaactgatggatcccatgcgagtgaataaagaatggttgaataagaaaaactaagcaaattaattgaccttgaaccatgcgatatctctttgcatttgaatgcttgctcttaaactggaaaattcttcgaattcaactggtggaagatgcgcagccaagtgtagaatgttgttaccacttgagtttggtattagcatgtcttctggcctcatacgcttaaccaactctttcacaattccacccttgccgtcccttactgctagatgaacagctgtgtctccacttgagtttagtattagcatgtcttctggcctcatacggttaaccaactctttcacaatttcaagactgtctctctttactgctagatgaagagctgtgtctccaatcaagttttgtattagtatgtcttctggcctcatacgcttaaccaactctttcacaatttcaaggctgccgtaacctactgctagatgaagagctgtgtctccaaatgagttttgtattagcatgtcttctggcctcatacgcttaaccaactctttcacaatatcaaggctgccttgacttgttactgctagatgaagagctgtgtccccaaatgagttttgtattagcatgccttctggctccatacggttaaccaactctttcacaatattaaggccgacttgatttattactgctagatgaagagctgtgattccatctgagttttgtattagcatgtcttctggcctcatacgcttaaccaactctttcacaatatcaaggctgccttgacttgttactgctagatgaagagctgtgtctccatctgtgtctggtattagcatgtcttctggcctcatacgcttaaccaactctttcacaatttcaagactgcctttacttgctgctagatgaagagctgtgtgtccactatcatttaacgacatgcgtaccatatcaggacatttttcaataatctgtttcgatttgagccactcttccccgtatatatgtgtccccagatctacttttaaagaacctgcaatcctttcaaacttcacattataatttctcgtttaccctaaatctgtaaaaattcttttggaaacttgtctcaaattttgaattcctaataatttcatcatttgtaaattgaaatctagttgagaaattcgagattatgtagtcgaagggatccaatcatcaatcacctttaattaagtttgaaaattgaatttcaatttgtgtttgaaaattaattctatgatgataagtaaaatcgtttttgagagaagtaatttattttttcttttcttcagttgacaaaagctaattgatcataacatgcgacttatacttatttatactcatactttaaaagtcattctacttttttttttttatctttcgaataaaataataattttctaaacccgttgtttaaatatcattgttataataatagtatagatttattttttttaacgtcaagcgatttcaaattcatttttttcaaaatgtaaaataaaaaactcttaagacatgatctctgaaatgcaccctcttgtgaatgcaatagtttaaagtataacttactcagctcttctggagtcatttcattcactcctctactttcatgttttggtgccggcgagtttgttgaagtggcaattggagtttgctcatgactttgatttatctgaattatgtggtcatctgaaacttcgctattggagttcatgatttaattctagggaaaatgaagtgatttggagacctctatgaaattcccagttctataagtgttgcttctttctttccagcctgcgaagcttgaacatattatatatggtggtaaaacaacagcccttaaatagttttacttttccaacttacacttaaaataattattcccaatatgacattttgtggattacagcaatgttcaatctgttcaacacctcaaccctacagttttcaaaaactttttaagttgaatgatttctaaatttgtaatattaattcttttttaaagagaataaatatattcattaaatttgttaactgaaaaaaattatacacattaaattgtgtggattaattagcgagactcagctatcacaacactgttaattaacttactctcaatttaatattaattttcttctttggacaatgatatgatcgatatctttacacacctaaaaagtaaactacacaaactatcccttaagttttgtgaaattatataaactttcttatacttttttaaacatttacaacaatctcgcttatagttataggggcagaaaaaacatgaaatgtttttataatttcatgaagccctataaaaatggttaatgcaatttattcttttttaaatgtgtaatggaagaaacacttacgcatagagatgttgcgcaaattgactcagtaaaaaaacccaaaccgaaccaatttattcaaattattttgaccaattcattttaaatccaaatagccaaattactatagaaaattggtttgaaatcgaattagttttaaaaaaattagtttgaattgaattgattttgaattaattttaaatcaattttaaaattagaatagttttgaattgatatttgaattattttaaaaaaattgatttggatgaaaaccaatttgattaatcgaaccagttttataaaaatgattcggttaattgaacaaacttttgtacaacagtgtaattcatcttttcttaaaccagttcagattaatcaagttgatttttttaactccattatttacggatgtattgtgctttcagaaaacctatttagtaaccaaaatatgaatgcatattcgtaaatacatgcaaaaataattacaaaacatgtgattaggagcatatagtacattatgggacatttagataaatataaatgtatttcaaaattcaagtattttgtaatgatattttaaatgtgttatagaagagatattccagaacatcttatggagagatgttctttcagcacacctattccatataaccaaaatatcatactttcaaaatcatatattatgtaatatattaaaaaataataacagaaagggcatttcaaacacataacgaatatgtgttgttcttctgacatgcatacttattaacctaagtatcatatttcccagaatgggtattccacaatacattaaaaaataattacggaacatgcaatatagaacaaataattagaagtattttgggagccactcttaagtgagaaaggaggtgtaacgtaagttaatttttataggatgcaggaagaagagaaaagatacaactcaatgttaataaagaaagaaaaaaaagaaaaggaaacaaacaaaagaaactagagtggaccaactcaaaggattatgaaaggaaactagcatgcatcacagctatatatacaaattaaaggttgaaggaaagaaatcataccccaatgtcttgttaatgaagaacgatggagataaagaaatgcccgtgggatgtgtgaggaggacccttgtcttgttgttgctgtacgttgatcagtgtctgagtgacaagggagcggtttctgagcaatgttatatgcaaagagagtgaagcttaatttatgagacttaaggctgtggactatatataatttattaggtggtccggatcaaacacaatcaatatcttcactgttttttatatgacatatagtgttattatttttttcataaattataaactttgaatgcatgttatgtagacattggttgagattatgaatacaaagtgattccacatacactatttaattaatttctcgtggctggcccatgtgccatgacaaaaaaaaaaaaattgttgaacccacatgcaaataacgtgtactgattttttgagtggggaaaaagcaactgcagtagacacagggaaaacaaacttctttacccaaaattgttaccttacttttttgtttttgttgtcatttttttgtattttaatatattcctataccttttgcatttatttaatttttgacttatttttatccattttttgaggcgtatatttgaaatgatactttagattaattgtaaagctaagcaaattgctttgttagattcttctgaatgtcattcttttcaccttccgagaagccagaaggggtcctttattcctttgttaaaactactgcttccaagtattccatactaacaaaattcttttcccaccaggtgggggtggaatatatagataaaaattaaaaagccacaatgtcttattataaatcatgccatgaaactaatcattcaaatataattaatataatttttcttggtctctccctatctctaactaatgcgactatatcctccatttgatcctgatctacttcctttcttccatgacctgcgttcagcacaaaaaaagaaaaaactaaaaaagaaaaacaaaaacaaaactaagccaagactcctaattgttggaatacaagtctgagttaaagtcacacatcggatagaattagaaaagttgaatatcatataagtgaggagaagacccataaacccgagtcttaaggttttgaattaaagtgtggtgtctaaattcacttatatggttgctcgtggaaatccccccgatgtttaccctcctcgatttctcaacaagtggtagcagagccgatagttcgacccgtccattggctcggacaagtaagaaggcggattcctgaacatggaaatcctggatccctgaacatgaagatccgttgtatcgaaagtcttcctggtggatgaggccgttgtatcgaaagtcttcctgatggatgaggtcaggcaacgagtcccgcaagtgttgcggcggtacaaggtggccactacttgtaaattgaaaagtgacttctgcttgagggggaggctaccatgtggaagagactcacacttgagggggagattattggaatacaattgtgagttaaagtcccacatcggatagaattagaaaagttgaataccatataagtgaggagaagacccataaacctaagccttaaggttttgagttaaagtgtggtgtctaaattcaattatatggttgctcgtggaaatccccccgatgtttacccccctcgatttcccaacaagtggtatcatatttgttggataattttcgtttttagttgactgatacttccgtttttatttgattgatagtttctgtttttatttgattgaccaaatcaaataatatttgatggcttaggcccactccattgtaaacccaattcatcctataaatagatgagtaagggtggaagcaagacacacagaaatttgagagcctcaagtgacaatcttgagtgacatatttgagcgagcctgcgtgctctacatttgagaaattcttagagagtttgagtgaaacactctaggtttcgtttgagtaaccaccattattggagaggttgagtgtaccaccaaattggtgtgttcttaattcattataaccgattattgttatagtggatttttgatactggactagatcccgtgagtttttccttttttcacattgaggaaagttttctcacgtaaaacaaattctgattgtctctctcgctccctttgattttatttccgcttccgcaatttgatatttgaggtccgagatactcaacagtggtatcagagcccgagttcgatgggttctgaagaagtctagatggagaccagcggcataactcacgacggagatatgttcaagttgaccgcagataacttcaactattggaggttgatgatggaggatcatcttatctgcagggatttatatgatcccatagtcttggaggagaagccgactggcaagttagacagggattgggagatcctgagtcggaaggccgtggctacgatcatgaggccgtggctacgatcatgaaatacattgacaaaagcctctttgagcacgtgtccaaattcacgaacgcgtacgagttgtggaacaagttagagtccataattcagaagaagactcctaggaacaaagcacatctggtccgccgacttgtgaagctagagtacaaggacgacatgagtatgatcaagcacctcagcacctacaaagaaatagtgaatcaactgtccaaagtcaacatgaagattgatgacgagatgcaggctttgttgttgctgagttcgttaccggaaagttgggatactttggtggtgactttgagcaactcggttctagaaggaaaactgacgatggatgctgtgacagacagcctcctgaatgaagaagccaggagaagagaacgaggtatatctagcacatttgaggctaacggtgctgagaacagaggaaagaccgactctcagggtcgtggcaagagccgagatcgaggtggacgagataagtctagaagccagtcaaggccaaagcatgacttgaagtgcttctagtgtgggaaggtaagacacaagagaccagactgcaggactctgcagaatgatgaacaaaacggctgtgtgaagctgaatcaaattgttcccagaagaagaagtgatcagagcaccacagcggtggctgctaatccgaatgccgagatattcctactcagtgaggaaatgttgaacatagcccatgatgactgcacctggattgttgactccggtgcctcgttccacgtcaccccacatgagggattcttctctgcttacaggaagggagattatggtgtcgtgaagatgggaaatcaggtgaccagcaggattattggtgttggtgatataaccctgaccacagacacaggatgccgggttacgctgaaggatgtgaggcatgtacctaacatgcttttgaatttgatctcgattggaaaactagatgatgtcgggtcagtaaattactttggagaaagtagatggaaactgaccaagggaagcttagtcgtggcctgaggaaagaaagaaggctccttgtatgtcatgcaaggaaagacaccataagcttggagctgtggcacaagcgcctcggccacatgaacgagaaaggactctagattttggagaagaaagagctgttgaccgggttgaagggtcaagtgttggagagctgctcgcactgcctagctggaaagcagcaccgagttccgttgtgagaccgaatcaacctaggagacggaggtgcattcttgacctcgtccatactgacgtgtgctccatgtccgagagatcactcggtggagctcattactttgtctctttcattgatgaccattcccgcaaagagtgggtttatcttttgaacacaaaagaccaggtactccaatctttcaaggaattccatgccatggtggaaaggaagactggcaagaagttgaaggtggtcaaatctgataacggtggtgagtatcgtgatccctttgaagcttactgtagagaagccgggatccgacttgagaagacgccccccaagactcctcagctgaatggatgtgctgaaaggatgaaccgaactattgaggagaaggtccgaagtatgctatcgaatgctagactggcgaaagcatattgggtagaggcagtgagaacagcagttgatttgataaatctctcaccatcacgaccgctggatggagagattccagaggaagtctggacaggtcggagagcgacctatgatcacctgagcgtgtttggatgcagagccttcgtgcatgtccctaaggatgaaaaggcgaagctggatgcgaagacgaaggagtgcatttacctcggttcgccaaaaatcgagtttggtttcagactgtgggatccaatcaacaagaagattgtgagaagccgagatatagccttccatgaggatgagaccattcatgacatctcgaaacctcaagtccaggttactgtctgaagagaagaacccgcccctcgtgaaagtgttgaagcagggggagaaaccagtgaagaaatcgctgaaggcggtattgtagatgatgaccagcaagaagctgatgatgccgggatccgaggtgagaatgaagaaccgggttctgatgaggctgaggaaaatagccgagataacccactcgagaaagaataccttctgcaaggtaccctgatgatgaatacaccatcattgctaaagatggtgagcctcagagttatgatgaggccatgatgaactcagagaaaggagaatgggagaaggccatgcaggaagagatgaaatccctgcatgagaatcagacctatgagctgaccaagctaccctaaggaagacgagctctgaagaataagtgagtgtacaagatcaaacaggaagagaacgggcagaagtcgagatacaaagcccggattgtagtgaaaggctgcaatcagaagaaaggagttgattttgaagaaattttctcttctgttgtgaagatgacctcgatccgaactgtgttagccatggcagctaccatggatcttgaggtagaacagatagatgtgaagatcgcattccttcacggtgagctggaggaggagatatatatggagcaacctaaagggttccgagcaccaggatgcgacggcatggtatgccggttgaagaagagactctatggcttgaagtaagcatctcagcagtggtacaggaagtttgattccttcatgacaaagcacaagttcatgaagactgaagctgaccactgcgtatttgtgaagaggtatgagaacagagactctctgatccttctgttatatgttgacgacatgctgattgtaggacaagataagatgaagattgctggattaaagaaggcattgagctcatccttcgctatgaaggacctcggccctgcaaagcagattctcggaatgaagatcatccgagacagaacgaagaagctattgtggctaagtcaagagaagtatgttgagaagatcttgaagagattcagcatggacaaagccactacaagcactcccctagtcgggcacatgaagctgagtaagaagcagtgtccgatgtctgatgaaaacaaagacaagatgctggatatcccgtaccaatctgttgtcggaagcttgatgtatgcaatggtttgcactagatccgacctggcatatgcagttagtatgatgagccgatttctttcgaatccaggcaaggatcactgggaagcagttaagtggatcttcaggtacctccgaggtacaaccaatttatgcctccgatttggagatggtgaagccgagctgcaaggctactcggatgccgatttggggggagattccgactcgaggaagtcgacgactggatatttgatgagatttgatggagaagtagtctcttggcagtcaaaattgcagaagtgtgtggcactttcaacgatcgatgccgagtacattgtcgtgaccgaggcaagcaaggagatgttgtggatgaagaatttcctcatggaactcggccatgaccaagaaaagtacaagctgatgtgtgacaaccagagagcaattcatcttgcgaagaactcgacgtatcactcctgcaccaagcccattgatgtgaggtatcactggatacgggatgcggtggaggatgggaagctcacacttgggaaggtgcacaccagttagaattggtctgacatgatgacgaagccggtaccagcaataaaatttgaagattgctgtgaaggagttgggctgaggaactcggcatgatgaagccgaggtgagaaggccaagttgttgaaattgaagacctcggtcgcattggaaaaacggaagggggagatttgttggataatttccgtttttagttgattgatactttccgtttttatttgattgatagtttctgttgttatttgattgaccaaatcaaataatatttgatggcttaggcccagttcattgtaaacccaattcatcctataaatagatgagtaagggtggaggcaagacacacagaaatttgagagcctcaagtgacagtcttgagtgacatatttgagcgagcctgcgtgctctgcatttgagagattcttagagagtttgagtgaaacactctaggtttcgcttgagtgaccaccattgttggagaggtcgagtgtaccaccaaattggtgtgttcttgattcattgtaaccgattattgttatagtagatttttgatactagactaggtcccgtgagtttttccttttctcacattgaggaaggttttctcacgtaaaacaaattctaattgtctctctcactctttttgattttatttccgcttccgcaatttgatatttgagggtccaagatacccaacactaataagacatgaattagccaaataatattactaagattttcaatctatatcaatttttgttatgttcagaatacagataagtatttttcctagacctacagtccaaaagcacatagagaaagagtcatttactgagaaaatgataattctaaagaagcatgcttacttctctaatggcacatgcatcttcgtctttgctctttttcccacgaggaaaaaataagctaaaccatgaatcatcaaatcaatccagcacgtcattgaaaaatgaaaaatgaagaccaaaaacataggaaaagtgtagaacacagtatcatccccaattagtaactatttggcatttcataagaacaaaacgcacttgttgaagatccagagcctccgagaagagcaccatcgtaatccccggccttccagaactgctgggagctattcagactcaaactcttattcgcattggcgcgcaatgccgtcgaattagaagcccattctagcgccagtaaggacaacatcgtagtgcgagtaggcgccggcaccggagggagacgcgtgaggaatccaactggcaaaaccactcctccagcctcgctcatcctcacttcttggacggactctctaccgaagaagaagcatcgttcactgtgttggcgactgcactgtccaaatcatggtcctcgtcttcatccatgtcggaatcgctgagttcaataaccgaacccagaaggggccccgaaacgacgccgtttcttggcctcctctcggtggcaatcggagtctccaaaacttattcttttacgcaaacatccatggctggctaaaacgggagatgaagattcaacaaacaaacatgtaaaataaaaaatataaaagattgaagttggaaagttaaaatctcaacgaatgaatcaagtgaaggtgatgggaatggttgaactaaaaaggggatttggctctcgtagaggggaggagaagaaagacgcactccgcccttgatccagggaatatccaaatgcagcacgaccacaccttaacggcagcgcgagagttccacgacggcgacagtcgacgaagactacactcccaccaacccatgatcgttccacgatttcaaaaatggagcttttgaagcgaaaccctaaacgagagtgaaaagtacgtagcatagacatgaacttcaatttggtttcatagctttaaaatcaaagacagttctccaaaaccgtcttcaatttgggatcaattaatgtcaatgcataacttgattaatcttttaattaccacttaataactattacaagtttatgatattaaaaataaaaggaattgacctagcttgaaccatgccagctagctttctttctatttgaatgattgctctaaaactggacaatgctttgaattcaagtggtagatgagcaacttataagtgtagaacggtgttaccttcattactaaaaaaaaatgcttattttaattccgtccattgttggggtcccttaccatggtcacagtttactatcatcgtcaagaatccaactaagagcctcatcatttcctgatattagtgcaacaatattaatatgcaatagaggagaaaaatatcttaaaacaaaatgagaacgaccatcaacaataaataaatgtaacaagatcacgccacatatttagaaaaaaattttaaaaaaagattttgaagtccttaaatttttatgaatttatataaataattaaaaataaaaaaattaaaacgtgactttcaagtgactttgatgtagttggaatttttatgacttcaatattaaaataaaataaaatatcgaaatcgtaattttttttttataattttatatttagaaatgtaaaaattctacaatttatttctatttagatattaattaaaaaatacttccatttggcaattctaagttgggtatagatggaaagatgcagtggaaaaagagaaagaaaattcggaagcacgctcaaactagcatatcatatcttacttttattttattattattaattatatacttttatattttcaatttggtttaattatcctcttgatctatgtacttgtaacaaatttgaagttatatttagtttttaattagtccattgatctattttattaacatttttattttaacttttattataaattaaaacactaatttatatatattacaattttgaatgactaaatatatacataaaaaatattattgatccaatcctaaatataagactcttttaaaaataattcacattttttaaaaaattaattaatttagttattaacattatatttataaataatgtgtattatttttaaaaaattaccattaaaactttcagatatcatcattttaatattttacttaattctacctacttaattaatatgtgctagctaattatctgaatatctagttctcgtaatttagagagaaaatgaatttactatgttgttattagtttataatatttattataaattatttaagatattttggtaaaaaattaatgcaagagataaattaattaaaaaaattaacaaattttaaaaaagaattttatatttagaaatgaaggtagtgaaaaaattacaaatttatttttatttatcacaagatatattttcctatttacatggttgaataaaaaatataaaaatgtaactcaataaacaatcttgatatcttttagaatataatgcaatgttgcggtagatcataaaatgaagaagcaaaggaagaagagaaagaaatggaatgaacgagaacggaaaacgaaatggacatgcaaagttagcactcacattatttattccgtgggaaccagtggaatcgatcggcaaatgtttccctccatgctccactcttttggcttagtttgctttgcccaattcattgtttccttgtgtcaaaatcaaaattctatttcagaatatgtgtgctttgaatattattcggttaaaagtatagaaggtagcacaaatcaggtggcaactcttatatgtttttaattgaattgattacaattaataagtaaaagatacaaattataagatgaaaacatcctgagttttaaaatcaatactatctgaattaattagtgtcacttcaaatcaaatttctgaatgtcatattactatccaagatctaattacctgttttttctaattgtacgtgtctgtttgttcttccattttctccatatagattacgaatattacagtagaacatgagtggcaatatagagaaaaataaatgcaaactaactaaatgattggataaaacaacacaagagagatcaaatttaagtaaatgattatttcccgtaaatgataattatttcccataatgatttactcatgatgattcaaaaaataattatttcccgtaaatgataattgtaatttttatcgtaaaaaaattaaattaaaattagtttacattatgatatagtgaataagtaatttaaattttttgtaacaaaaataatttttataaattaattataatttttatctctatcaacactaaaaatatttttatttatgatattagtgataaagtaatttaaattaattcactttaattcacgcttaacaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaaataattgtagtttatataagtttgtaaataattaaataaattatttgttttaattgtttgacaagttatgatatagtgaataagtaaataaaaactttcttgtaacaattttttaataaattaattataatttttttctctatcataactaaatatttttatttatgatattattgataaagtatttttaattaattaattttgattgtcctataacgaaaattcaaattattattttataataaatatattgactaaatattattacactggttataataaaaattgaattaaataaaaagagtttaaaaatttcaaatcttgattaaatttaaataataaaattataaatatttttatttacaatatagagtgagagcatagaggtaccaattgcaatacaaactattaatttaatatttgattatgctcctcaaaattttagttaagggttccaagaattcacgttatttggattagtagcctatttgatgcaattgaaggcattttagagagcattggcaagcttatcgtatcatttttataaattaattttaaattgtcacctctatattttattgttattaactcattattttatacaatgaaataaaaaaataacatctttaatattctaaaagaaaactttaaataaagtgattgatgaataataagtaggatcaaataataaaccagccaaaatcattaatattaatgacaaataaaaaaaaaaactgattcatagacttaaataaaaagaatatttataatattatcctaaccatccaaatcaaagctacaaatgagataaaataaaacatgcaattcttttttttacacacttggatggcaggacaatgaaaagtaaggacaaataacgtatatatgaggtgtgtataatattctagagtgtgtatagttttcattggtggaccacacgattgcaaggttttggagttaggcagcagaatggcagaacatcatggaattaggttgcttttagtgagattcacttcatacaaggaagctggggatgagggacctaaacaaaactcagcaacatccaccaccaactgggaaaaagaaaaggtatttacccttatgaagaataaaagtttcttatatccctcttcaatttccaatcaaacaaaagggctttttaaaaaaaataaaaaatctgtgttaagtattctgttcttaattggtttagccaatagctagaaacaacataggaaaggatatcattaagagccagccattctcacaaaagggctttttcatcacaattccagtaaaaataatcattaattttgtgtcacaattttccctttctttaaacacttgtacatttaaaataagtttccaaccatacaaagtcccaaaaaatcatatgaaaagattacacaagggaggatgggagaatgttgaaaaataaagacttgcagacaaaacactaagctcaaaataatcatatccagcacatatggggcatgaatttaatagtgaccaacaaacttatagttgacaatcaggtcacatccatcatactaaacaacaaccctgctcggtttgcatgccaccagtccaagacgtactatattttgtcatttccaacacaactttgatcctgctgatagagatcgggtcaaacctggttcaagacatataccaagtcgcattttagttcaaaagtgtgtacttgaaatcagagttatagcatagacattaaacatcaaaataataacacataataaaactaaaataatgaattcaaatctcaagatgctgaatactttataagtaaaaaccatcctccttccctccccctttccactacacagacaaataaagaagaaacacattaaaaattcaacaggttctgaagtagtgcagtttagagagtatagcatgatacaaaccttagagatagcctccaagcagcacctgacttgtcattatgagcgacacctttactattagatgcacttccatagatatcatcaaatccatcatctttggcattatcccatccagcccaaccatcactgctatgggcagctgaccctttagctggtactttcttccttgtatcttccataaaatacttgaaccacaaacagagataaaaaaatacataagtgataaatgttatgattaaggaaaatagtgagtgctgactaaaaaaaatgcagatctttgctacaaaaggaaacagtggaactcacatagatagatatgtttcatatgtttaatgaataattgaatagcaggatttttttagatttcatagaatattttaaatttttttagcaaaacataggtgatgtaaatttagcaaagctggaaggttaaatccttgaacattaacattatcaacttctgccccccagttatgcatcagtcacagaattgtctgcctgtatggttctctctattctatattgaaggtgagtatattaacaacttgaattttgataatgtgatctgagtttcatcttggttaacagaagtggaactggagcataccttcatcaatgtatactacgtgattcccgtgcttggcactgatttgtggggacatatgagtagcctttaaggctgagatatacaccatattactcttcaataagtaagctgaggctagaacataacagtcatgccaaatatgtaaccagcagcatgaaaacagagggatgattcactatactatcataattataaatattctagggtgttttcttcttctcttgaaaaatgattttttttttattgtgcttttgggagtttctatgaattatctctgatttatgattatttgtgtttatgtattgctgctagagcactagagttatttctgcaagatttgtgtgatcgaacatatgagataactttgaggaggggggcaaagactatgaatgcttttcatttgtaagtgaagtttctattattttcttggttcaaatttttgtctatgtcaagtcggttcaaggtggttacaaggctgcaggtttctttcttttggagggcggttattactatgtacaattctaatgataatgtgcacagtctcaaacaatttccttcttgtgccttctatttatcacattcacaaacatgattagacatgtaaatgacatctgcagaagaaaatttcgggatggtcttgcttttggaacatgttttttgtttagtgtttaccttcactttccagtttctaaaatgtctgagttacttgcatccttgcctttgcagaaaccagtgtgtgcagacttttaatgtctttgattttctgaaagatattgtatgcaaggttcctgatttaggctgttctgttgcaactggtgatgaccatgctgtcactaagaggaggtttgtgctctggttaatattcttgttacttggaacaagttttctgtatgctgaactttgtttactttatattaggaaagttgccgatgatgatgataatgacagcgacgaggagctcaagagaaataagaaggtaatttataaactgtattcaattacttcatcagtggttagcttaaatttttcttgtgtgattgaaccttttgctgagtaattatctcttgtccatgcacactgtgaaccttttcctggatacaaaaaaaatttacttcagtcaatagggaaactcactagtggcttgtgaatgcaagtacgtctaaatgtctaatagtctgtgaggctaggccacacttcaacttaaaacttattacacaaagcgccacaactgtctggttttctgaaaacttttgctgaaaactatagaattggcactaaagaacctggcagctgtttaatattaatttttatctgacttctggaactttgttttttttcttcatgatttgcacagccagagcctggacataagagtggcagagggaggggtgggggcagaggtaggggtaggggccgtggaattagaactgtatatcaataggtgagttcacatgccaagtgggaagatgattctgatgaattgaagcagaatgacaaccacactcaaagcaatgaaagcatggaaaatgtgccagaacctgaagtagttaagcaaagttttccagtgagcaaaccggcttaagtgtccattcgatattttgacttaaatttggacccagatgaggatatggattcattagacaccccaacttctgtcccaatgatgtgttgctaacacatcttagatttaggctaattttaggttataatttaattgaataagtaggaatataggttagaattagcttagttgttatttacattcaatttgatctcatttctttaccaaggtataatttcagggctaaaaaggaggagaatcaagccaaagaagaagaaaaatcaagatgaaggtctcgcgcggttcgcgccaagcttcgcgcgaatcacgccacaatgaaaatatcaagcctcaagttcgaacaagtcgcgcggatagcgccatgtctcgcgcgattcgcgtcaaaggcccaggatcaaccatgcatctcgaaccatccacgcgatcagcatggattgccacgcgattagcgtcatgaagccgaatgatccacgctatcagcgtgaagtcttgcgccactagtgccagaaggtctgaagacaacctccaactcgtgccatccacgcgaccagcgcggaatcccgcgcgatccgcgatgcgaagacgctatttccttatttgaaaagatttggttcgaaaattgggaagaaaaggggcttctgttactggaattaaaccatcttgaaggcaattataaaaggaggcctctgaactgaagaagatcatcatctatcatcttttgatcattctacacctttggaaatcattcctacatagaatcagaagctagggtttgctgcagaagaatgtttcatttgacagctttggtgttcctgatgactatgtcaggctaaactctgtattgtggttaggccaagaaccaatgtgaactcctttataatttgactggtattgaatgagattactctgattgctttattttctctgttcttcattgttatattctttcttagaattcattctatttaagttctgagggttagaattcgcaatagggatgttgggattctaatttctgacatgagaaagataacaattgttcattgcctaggaatagggatgcgtgattgcagaactttataatatattcttttaaatgcttagcttgatagaaatcactaaggaattagggttttgattcaggttaaagggttaattcgctaagggattagggattagctaaattagaaaagatttattttctgattaatcagaagcaatcaactttgataaccagttaagtgaaagaggcaggaatcaaaggggattgcgtcctaatcacaattattcttccattggtttacaactcactctacttgcattttaattcgttttaatttctgtcaattacttaattgttcaactctcaacacaacaaacaattctttcaaaaatcgtttcttttcccttccaattgcttagactgcaaattattgtgaaatcagtatcaatctctgtgaatacgatactctacttacctactctattacttgaaacgagcgatatacttgccgttttcgcaacacccaactggttcatctgcaaaatcagtgtcagaagagaagcatgaggaataccctggatggtccttgtctgaaatggaaaaaatgaccattgatcccattcaactagcgaacataaatggaaggattgatgaagatgaagaggattatgatgaagaaatgtagatgaacctgtgtcggtttattaattacttctcatatcagcctcaaatctcagatgattttgttatttcctcctattcaggtatgcctaatgcagaagatttattgaaagacaacacagtagtagacaagacaaaagtcggaattggtagtccagaccaccatcagtacattgaaggagaggaggatgacgaggttatgttttcaaacctatagtagctgagaaacaagctgatgttgttgtttcctcatcacgggcaccccatgaaggcttagaatcagcttcaacagcttctattggggatataaaatttaattttaattcttcttctaaccctctgaatgatgtgaatcatcaaatttctttacctgcttctgttagtgctatggtgcctcaacacctgcaaccagttcagccacattcttcaaggtggtggttagaggaggaaatatctcttgctaacagtttgaaaggtcttagattcttggagaatgggcacgtgatgaaacctgacttaccatttaaagcagctgcggcaatctctgactatgctgcacttgcagttcctacccggcaatctgtaactgctagtactagtatgttttatgctcatgatctctcaaaagctgaagactttgcaatatcatccaaaattgaggccattgcatcttctggaacattcactgataactctgttgtgaaaacatcatcaaccttgcaagctggtttgaaaaaatctccagtcagccgaccttctaggcaccttggtcctcctcctggtttcagtcatgttcctcctaaacaatgtagtgaacccactgtttcagattcgattagtgggaatccattatggatgattacagttggttggatggatatcagttgcctgcatcaaccaatggtttaggccctaatggtcctcttactctcagtcaaattctcatcaagttggtaacaatggtttgagtgggacagccagttttcccttgcctggaaaacaaattccatctacactgcaggtggagaaacagaatggttggcaagattttcagactttggagcttttaaaagcacaccataatcagcagttgcagtcacagttgctcccaaatggaaatcagcattttactccactgcctgatcaatttcaaggacaatcaatctggacaggtcaatacttcgtgtgatgctgctcgtcagtatgagaatattgatggtacgcttcccatctggatttattggtagggctattcataaactgctgattatatttcagatttgattttgaaaacttacccaattcaaactgaaattacacacacacacatattattttaaaatttatgatagtactcatggttacattttcatttcttatattttttgtaaaaattatcacataacttaatacttatttatgaaaaatgtttaattaaaaataaaaaattatttacttgagaaaaggttgttaaacaagacataatggagtgagatatagattggcggacggtatgttttaggatggagtcgagaaaagttataagcttggtggagggttaaactcattagtagttctatgttttcgtagttcccttgtttttgttctcttcctcttcatttttttccctcttcctttctttcattcgtcttttattttagcttatttttttctctgttttgtcttatttctacttttttcttcccctcttccttttctctttctttgtcttatttccgatctatcattgggtttatccagcaccgaccccaattaacttgggttaaaggtgttgttgatgttaatgttaatgtttaattaaagataaatatttagtaactatgtgagtactgaccaaaggtatttaaatataattattaagctgtgtaaatttatttttaatagtatatatttgaagagttatactactattagctatacattgacttatagatgagatatttgatattttaaattattttttattatatttattatgtgttactatttaaaaaatgaaagctaattcgatccaaactgccttatagattggattggaatcatttggttgaatttaaattttaaaccaatctaattgaatgataaattaagaaaactgaagtaactggactggataatattgctgtttgtttgaaggatgcctttcattttgttaattttttggattgctaacataattacatatttgaggtcctcgaaggattattacaactaccccttcaaactccaactctactgccttgtcattgaattttgttggagtttatctggcctagacatgttgcaggaggttgctactacaaaaaggtgggtaccaaatttttattttactcattatgtttaaaactcgcaaaaattgaaatttggacaatttgtgtgccacacgtatccacctcctctactaccatcttcataaacagttttgggatctactaggattcatggctgtatgttctgaactgtttatcggtcattatgtgttaactgctgaacttactcttacataatttgcttgtatattattgtagaatttgctgagctctcaagtccgggtgatcgaagataaacaagcatctttagggtggatagagggtgataaataaaatctagtcatcttggagcttgtatgtatcttctaagattggtggtatggctatggtttgttcacttctccattggaaatgtcataatggtttgccatgcgcctgtaagaattgttaccgtcatctagctgccggtgatacatgatgctagcccctttttttactacctcaaagcttaagactagttgggaagattggtaggtatgaagctcgtttaagttggataatgggatatgataatgactttgtgaagcatgcttgagtaagcacaagtgtctagtggtcgcatctttgttaagattcttatgtgttaatataaccagtgatatatacatacggtttactttctcccttaaaagcttttacctagtcgggttttactctaacttatgaataagtaatccttgttggatggtggattgtggatatgtcttggtctatataggaaatatatctatctaaagtagggatttgattgtctctatttactgctgctgtgatttattgcttttgttgttcagaagtagcatgcagcagttacttacatgcaattcctttgtgttactgtttgtctttagtttaacaagaaataacagaaggtagatggaaagagttagactcatttatcctaatatgaacaaaatacaataaatatttaaacttgcgagaaaatgtctgtcttctcttcctgagaggggttgggaatggtagtagcttagcctgttcatcctctgagatcatcagacatttcgtttggaatttcatcatgtcgaagcgtaccaggtctttgaacctacaactgccaaagtaattgcattaaagatattatctttcaggaagacatatattaaaaagggtagatggtattggattggaattttgagtcacccaagagacagtgatgctttcaagcaagtaaatattttttgataccataactaacaaccttaaatatgcaagattaactatctctacctacattatataacctattttacctattttacagagacaactagcaactacttactactttaagttgtgatcaaattatgatggtataactttgctaattatataaaattaagactctttttaaataaacttatccaagaacacttatacccaacctttttagatataattttaccgacaaaaaaaaggaaaaaaatatgaaggtaaaacaaatttagcttttttataagttaaaacaacttatacatataaacttttggagaagtcagatgaggtaccttctagaaaagtcaggtacacaagttaaaactaattcatttattctctatttttttcctatagtatctataatgaaataaaaaataatttgtattctaggatgaaggtgaacaatcaccaaaaaaaactctcgtatattcaccaatcttggacaactctctggtcagtaatttttcatttattttaaaagaaacaaaaataacaataccatatttgtgtatctactatttccaagttatatccgttggtaccggacaatcacacagtaatcgaaaaaaacaaaaagagaaaaagaaaaaataacacacaatgtctatcctgattcaccgaatgtgggttacgtccaatttttctctatattttcttcgcacactcgttacaatgcacttaaattacaaggaaatatatagtttagagtaggaccccgtccaagaacgacttatcttcttacggcaaagtatgagtcatacccaacaatatcttatatgcaaaacaacaaaaatgagacacatagaaaatagaatgtgtaattattattgttttcttaagggagagataagatattttttttttgaaggaaaaaatattatcgaaaatgaaaaatgatgaataccattatgacatttaaatattattttgatttttttaaagggaaaaatattatttcaaatgaatctatttaataaagatagagatatttattattttgattagaagtgaatctattaatttaaatgaggaatttatttgaaagaatcattaataataagtattaatctaaattagataaaattaagtcattaattattcttgtgtgcaacaatgcaatgttgcatacattaaaaaaaattgaataataaatattatttgatttcaaaataatttactctatccatttttatttatttttttgtcctgagtcaagaaccatgaatgtttcctaatccaatgaattaaaagctaatttcgttcgtggtgcatgattattgctaaccaaaaaaaatttcgcatgaaaaaaatcgattacaaattctccctccattccaaaatgaatgaagttttcacatttaatttttttatattaactgatatgttcagtttccaacaaaatattaaaacttctattctaaatttgtcataaataaatgacattaatctcatacatttttagaatcttgcttgtacctcaccataatggtacaaactccttccattaaagtcacacttctttttccttatcctttttttttattactacaccgcctatgcagttgaagggtttatgcaaatattggtgcttttaactagtagagaaacattagtgaggagaggcaaagactagtttcatccacaaaagctgggggaaaacaaaacggataagatgtgattccattggttgaactatgacaacaagcagtttgcaaacagtgtaaggtcttgtatatgtttgaatgcaaaaaatttaccggccattaaaaagaaagaaaaaaataaaaactattttcagagaaagcacgaaacatcatttgtatttatcacaattcctatttgcttaaacttatctattttgacatgtatttgtagtcctcatctcaaaatcactggctttatggtttatcatctttccctcagcttttatttaatgaatcccattcaggtatgtttgcagtagcctcattgaccatttttacaagccgcacctgaaaatgattattgcagtatctattaattgacaaaaactagcaatcattgaagcacaaaatggcattaatgaagcttcagttaaaacacctctagtatgaaggtttagcaaagactatgtaaaatcacatcaaaaccccaccaaacacacacaaccaatctttcccattcaactgattttccattgggctcagccattgaggtccagtggtccaccaaatgctataatagatgccacaaaaacaaggctaattctaataccttgtggcttgtactaatggcataacatgacatcaatgggnnnnnnnnnnnnnnnnnnnnnnnnnnnnnnnnnnnnnnnnnnnnnnaaaaaaaaaaaaaaaaaaaaaaaaaaaaaaaaaaaaaaaaaaactcaacataagcaacaacaaaattgcagctattccatagatcttcacaagtaaaattttggagaaacaacagccacattatcaatcatgattcattctcatcaaaaaatagattccctaccgaaaatactcagatgatttcctgtgtatatatttgcatcctatgtgtttgattcggttttgcagtggtaatttgctgaagtaaatttaattatttgaagcactttgcgtgcaaaagttagaatgatatggtccataaggaagcagggggcaatggcatgcacttcaatatatcggttttactacctttgcaattgttgccacaaactaaagttacatataatgaaccttttctttatatagccatctgtcagaaagatgaaccatcgtaaaattctttactaaattaacatgcaaaatcaacattctaaaatttaaattcagatataatgagaagaactttttatctaattatgggttaataaagcaaagcaaaaagttaaaataatggagactgaaatagaaaggtaagtgtgaaagataagtagaatgcaccaaaactcctccttttggagtatttaaaaacacaaatgacatgagaaaataggattggtcaatagtgttaaggacattttctaatatagactgtttggcaaaattgcaactttccaacatcaactgattaataatttcaaagcaagacacctagaaaatttgaagcatggacttaccacgctttcaggaactcctggaggtggtaaggggaggtttttgggtggaggacccaaaagataagatctcttgtcaaaacgccattctccaatcttcccatatgtcagttccccctggatgaagtaataaggagtagataacttacgcacatacaacaactaagcatgcaagactcacattttatacaaggacaggcataagctaaactgcaaaagtaatactaaccacagaaatataggttctctaccttactttcacatcattcttgcattaaggagaatgaactcaccttcatattatagtcacacccatatgtatagtggatgataaacttattctcgacatttaagtcccaaggtggctgaaacattccaatgatgcatgtcatggacttgtgtatgaattccttaagtaacaattacaaaacaatgcaagcaattcaaacctgaagcataaagtcttttcgaagattatgctttacaccatgcaatgcagatgccacagcataagcatacctttactcaacagagaatcaaagcagcagaaggttagacctattagtacagaccagggtccaggaaaagttataaaatgaaaagaatatcaataaatgataaacaataaaaaatgaagcccccaaatcttgaatttctatggtaatactcacatttcaagcacccatccaaaagctttatcagtctctggatcatctttcattctcaatgaaatatttacccatgtgggagctatttcctccagcaaagactgatgataaagaaaattcaatgccttaaatgaaagaatatgttgcttatgggaaaatcacgaaaatctgatcataattataacagtaaccattacagctataaaggtcacagtataacaactataaccaatcaagcacagtatgcaaactattgagacttaccttcttaatgattacaggagaattgccaattggatcaacatcagtaacaggacccttttcctcaggatagaatttcctgattattttttcattctcaaatggttttatatagaaaaatggaaatgctgcgggcagggttccatgagccaaattaggcaaaggatttacaaatatgtggtcaggttctgccatcagaatatatctgcaccaatcataaaatgcgctgcctcttagatttcattattggagagcataaaaattgtagaaaaccataattaaggcacttactcttcctcaatatctgctttctccagccactgaacaaaagcccatggtctatttaggacaatataaccctgcaccaaaaataaatggacataaattttgatgacagaatgaattgatgggaataatatagaaagatcacaaacaatgacattcatgaaagagttgataactatcaacagtgtagaacgtgttaagtcaacaaacatgccactggacaacatgactgcaaccaaatatgaacccaaatctaggttatcgaaactcattgctcaaaagcagcttatttgggcatacacttattgagacttgtgagttcacatactaatctcagttatgagagttccccttggctgcaaaacttcaacaaatactaccgatacacatttgacaatttggaatatacacacagtaagatgcacagtaaacggaaaaatactcactcttttgctctaacattaccttgcttagaaaaaaaatatcagttaccaaggaagagagacagagtagaaaatcaaaatcactaagatattgtcagtgttactagttaggcatacaagggagacaaggatggaaacagattatttcagaaataaagaagcaaaataactgcaacagttcctatttcatctctattccctgttttatctgcatgcataaaccttcattatttgacatggacaatacgatatgcaaggctaatgaaatgtagagcccaccaaggttcatataatgacatgtggtaaagtggatcatatagtcttttatagatgtacattaaaaacaattaatatgtaacttaaacattgcactatggacgagtccccagaggcttttgcttttttctcaaaccaagatgatgctatgttatggatgtgattataccataaatgctcaaaaaatagctgcatattaacatattatctttctgcacttcagtttctgttgtccccacaccacagaaccatttttttgcatcagaccttaaacagtagcaacaaaatacttcgatataaaatcagttgtgtcaatcaccatcagcaataaaaagattaattaggtgacaagaagaaaaaaataatggaaatgacttttcaaatccaaaaaactggcagcaacaacaatcattagtaccactacattataaggcagaccaaatgcagaacaccaaatagttaaaataaccagggccataatagtcgaagaaacatgcaagatattcaaacaaaaccatcatataaaccaatcccatttccctctaaacacatctcattgcatttgcatcaagtgaagagaaatttcctccctttagaaaaataaactcttattatgtatgatgaggagaacatacgccatggtaacaaataacgatcattctgtgaattcttttagacaacatatttcacaattaagtagcaacaacaaattaaaatttaaaacatattacttcaaacaaacaatcatccccatttcccccaccccaaagttgtgaaaggtggcttactctgtatgtcaggatttgtaaatttgctatagggtcagaaattcaccaaaaaaaaaaacgcaagtttaaacgggctaaaaagatacaaattctgcagggagtaacagaaaaacatttaccttatccaagcccccaggaagtggatcaaccacaaaactaggaatctcatccatcagctggtctgaccttccagagtgcaaaatacgcgtgaacttccccatgtcggatccaggcatgtccttcactttcttataccaatagtacataatccggcattgccattgattgtaagcagcatcggttgccgtcatggcaacatgaaactttgaattagtcttttctgacctcataatttttctattaaaagattccaacccatctgccttatggtccatgatcatagctaccaaattataagtggcaaaggaaaaaagaagcaccatgagcagcaaaagcagtgactttacccgccccatgctttttctcacaaccattttcaatatcttcacctattcaaatatgaattctcagaaacccccagaaaccaacccttttaaacccccactcaaaccactttagtccttcaaaatcacaactttagtgcatagcaatagccaacagacacaaacacaatcctttaaccgtttgcttcacacacaaaaaacctgcatcataacataaagtagttaatgtgccacgtaactgcaaccaatgaaataataataataaaaaaaaaaaaaacaataaaaaccactacataaaaccccagaatctgaaacgcataaaaggtgaaaacgcatgcttgaacatgaatgaaggaagactcacgtaaacagatctgaacttacacggcaattcagggcaccccaaatggggaagactcaaactttgaatgagagaagatgcaaaagaatgaaaatttggaggaaaaaaggcaaaggggtggatgtggaaaagggatttgtgggggggttgacttttcaataatgggtgtaagtagcaaggaaggcactagaaaacgcggaggtttgaaggtggaagagacagagatgatgaatctgagtgtgtattgtatcagttgactccaaaattgaaataaatttaaaaggaaaaaaaatgagagtgaaagggatgatatatgatgatggtgcggttagtgcacaacaccaaaacgaaaaggaaagaagaaaaaaagtgaagaaagctttaagaaaggttggtcatggggttgcattggacgcaaatcccggtttcagacgcattctaatttgcctccatctcaatgaatattcatgcaaaaggccactccaaaatccaaatccaaagagatgcacttgccatccacagggcatgtccttttctatcaatgttgcttttcctttttgttttagtgaataaatatattttttgtcctcgtacaattaaaaaaaatgttcagatttggtcctcatttaggttcgtatggcaaagtttgataactctaatttattgtggtctatttttttattattgcaagtgacttttcatatgaaaagaaatgttttttttccttgggataccccttggattagatattagagtttcaatgtttcatactcactccatcataaattaatcttacttataatatataatttttttttatttaaagagattttgacacacaaaattaactctaaataagatttttatataaaaaaattaatgtctatataggaaaaatttgttggcccactaacagcgaaggctatcctatcgttgcatgcaataggaccttatatcattcagtaaactctatgaattacttaatgagttacattataagtttattaaaaatatatcatgtaattttaattttagtttaaacaataaatctttacgtattacatcaaattgaagatattttaagataaatttaaaactattgtaatcttaattaatcttcatttaaatttcaattttaaaataacatatcaattaagattgtatgtctttatttaaataatttatttcccttcagaaaaataaataattttcatgaattttttccaaattttaaaaatcccatgtatttaatttattcttatataataaaataaaataattattaataacattcaaaacatatattcttctctttaattaatttttattttaataaactttaaaaacattactactgtaaatgagaaactaactagtaccgataacatcgggtaagtaacttttactgaattctcattcatctaaactttaattgtcatgatttgctaccaattaaaccaattttaaatgctatttgttttacaaaatttaaaaataagtataagaaaataaaaaatgaaaatgacaagttttagaaaatgacaagtcttcgcttttatcaccaagaaccataagtaccacaaggtggtgcaaaccatcaccaatccatatgttcaacctattatgaatagtatttacgctaatcgttatgctattacaatgagtagggctcctagtgacagatgcgaacctagataacttatttaaccacagacaaatgcaccccgttattttaaataaagttatatagatttatctatattttactttcctaattttatatatttaaatctctaacctatttttatttgagaataaataatatatttccttattttaataaaattatatgtaatttattttaaaattttatttatatctcttatttttaggtgtttaaactcagtttcattttttcactccacttatatgtttaatgtttatttatttattcatgtatataatcactaccaaaaaacatgtttttacttacaggtatcttgtagtggttaccaaaagccgctacaaataatatgattgttttcactgcaaagggaaattaaaaactcaaaaagcgagcatttgatgtcactgtacctttgactctctctctctctcttctttaaacaccccctttccagtccgctccatcgccgacctttctctttctctctatcttcaccacacttttctcttagtcacagcacgctggtgacaaccatggttagagtccgagttgactcgcctgattcacctacctccaccgagtccgaatcagtcctctccaaggaccaaatcctcgtcgccatctccgagttgtagaacagcacgaactgcttcgactcgctcgcaaaaatcgagcgtttcgagctagattccgaggagaaccgcaattttctcgatagaacggaatgcttcgtgccggtgctggttggcttcctcgacaatgccaatggcggcgtcaaattcctcgaacaggtcgttacaacattggatttggttgtcggcaaaatggaagattgcgagggcctgcaaaatttgatactgaagaggcataacaggagagaaaaacagagcgtggttgccaaaagtcgtgccataaatatcgcatcagctagggttttgaaatctgtcgccgtagacgcggaatcaaagatgttgttagcggaaaaggatggtttagtacccgaattgctgaatctaatctcagcattgtttggggtgacgctaagcaatactggaactggacaaccgatcccaattccaagttagaccttcagtttttttgttgtaattgttggatcatagttagtgtatctgcctatcatgatttctgggatattcaattttgtctgcaacgagatgatttcaattgcaactgtcatgttaccagtgatatctggctagtcatctaggaactattctagcaacaaaaaaaaagtccttggggtttttcaactgctctgggaattgagagtgtttctcggggtttggggttatgattttgacagctgaatttcactaaattcatggccatttaggaagaacattgacaataagcctcgttgtgcttgttgaatcaagccattaattactctttttgagtatgtcatcgcaagtgataaagccaaaccatacaacaatcccttggttcatatcaaattggaaaacatttcactcttctttttttgtgctcttttcctgtcgaaatatattctctttttcatactgtgatttgttaaaatatgttatgttcacgtacaaggtagctattgctgaaccaactttagggtgcacttctgtcatggctcacagctcattactgttgccagatccaaaacataacttcataaaataagtaagttcttttttgcttggttcattctcaatccattcttccttttttttataatactgtttggttagataaatcctcactgtcaaaatatgttagagtacagctgtcctaacaaaatataacttagtgatacactgctacatactctaacaaaatttatcgtgttttatgctagactttgttactgtaataataatttgatttatttcgccacttcaacctgtgaaaaccaataaaattattgaactctggtgtgtctaaaccaaaatttatttttctgctccattcattctcaattcacttgcatttgtatccagggattccacaagattgatactgaaaaatgggagtttttaaatgaagctttccagcgaggaaagagacatcttctgaagaacattcaaaggcgcgggccacctcagtcccatcaggttggtagcaatattgtgccttattccgatgcaggtaaggccgggctgaatttgagctagaaatgtaacaacctcttctgaaataccagaaatgtatccaattacacttgaagagtctccaaattacctttctcaggctttgtcaaaacacttgaagagtcaatctaggtaaatttctaaaatcaagtctgcagtgtcttttttttaatgagtaattactatgcacatgtttatattttagttaggaaagttgaaaaagatttttactttttaactaataaattcttcattatttattttatatattgaaatttgaaattatgtactgaatttataaaaatattttttgagtttttatccaaacatatagtcttgaggtgtgtttgggaaaatgttactttcttggaaacaatttggtctattattatttcttactatcttttgtcctttcggtgacaggagattctcttttttcttgctaggatacctcaagattgagccttcaatcaaagttgtgtttaaatctgatagtagtaaaatcatcatacacacttacacatgtatgtatactctttcatatcttctcaaagtgaatcctctgctgttgcatcagtgatttcctctggtttcccatagcgaacaatattttttgcatggtagaagattattatacgagaaatgctgactacttttggttgtgtttctattaatgtcatgtgctaaccttttacctagtcatcatcaaattgatcaaggttcaacttcaataatttatttaaggtatgggctaattctcaaatctcatgtctaatttttatttatattttagtagtcttccaagttataagttattatcttggcttcattctggccaatttgcatgtaactgatacatagtagtttgtcacatgatatttaacgaatttattttactttattttatctttacttgcttatttgtacgtagtttcaggtttttatgatatattaaaaatgtgaaaaatgtgcttaattacataaaagggaaaatggttgtatgttcttgataaggctaaacacattattcttacagacctaatatgctaaggaaaaaggttgatgttgaagtctttgaggaagagcataacaatttacttaagtattttgagaaaaaggtgagggaatacacgcactttagaggcataaatgggggtgatgattttgaaccaaatatcaatcttaaattgtttttgttttggcaaggttgtcacttgtgttttgacaaactatgacatttgaagttttttttcttcttcttttcaataccgcaggtctattctacaattgaaacacttggttatatttccccctgtatcagaagacatgaaatgtgattggtattaatatattgtcttattgtccatttaattctttgatatattatatattatccttcattttatatttattacctgctacacaaggagaatgcaattccttatggaatatttgttattttgcttgaagggttaagttatttctctgcttatgtcttatatatgtgacggagtttttctaagatggccaagatctccatgtcaaattagaagcttttgacacaggtaagtttctttcgtgtttcactcccttaatgacaaacattgaatattgttataccgactattgtcattttcgataaacttctccagctatgaagactggggagttgatgaactgattgtggaagaggcagttgggtggtgattgatggttgaactgacaggtgtaagactttggtcctcaagtttttatctttaaattgtttgaggttgattatgatccaccataaacttggctcacaacaatgtattagtttttgggtgtgtatgtatctctattgcttgtgcagtaatgttttagcttagaataatttttgttttaacttttttatatatatctataggctttctcaaaattctgatatataggctttgaattgtgcagtaatttatagcaatattagatagatagatatgtttgaggttgatttctgttttttgggtgtgtatgtatcacaattatgttagcattttgagtccagaaaatatgaattagctttctcgatggattttgagttagctgagaagggcagtgtgttaactgaaatttcttttaaaggcttttatctactacatgattttactatgatgaaaataacaatatcaattttaaaaacaatatcagttttaaatattgcatatttgagcttgtagtatcttatgttttctacttgaatgtagcatatgttgtcgtaaggttgaatatgtgtttatattagctagtaattgcggttcaattaactattcgtacttttctttgtctctgacttacacaacttgcttgttattgttgttaaataatctatttattataattatagacttacactgtaacacatataggaaataggattgtggtcgaagtaatttattcatatttaaaattaaagtttattttaactcgcgtctataattattaataccattttggttcatgtggttagaccatcagcaatatggaagaacatatttatcttgtatagaaagaaaaatgagaaatgcgaggtgaaatctcattagaaaaaatattaatgagtttttttataaaaaaatattaataatgatttttatatttaatcaaataagaatgaaaataattatagaactaataaaaataattaaaactagagaaatattaataagagtttttttatcaaaaaaatattgtttttggccaaaaaaaaatactatttttagcaacaacaaaaaaaaagcaaagatgcactttgtggcggttttaaaccgccagaaacagaaaaatgtgtaaaagttaaaaaaaagtgaaaataaattttgtgacggcttttagccgtcacaatgtttttgacggatttactagtgttcaacttaaagccgtcacaattttttctgatatcgttacttctgacaattaatcctgaccgtcagaaattaattttgtgacggcgtttagccgccaaaaaaactattttagccgccacaaaaatataatttttttgtagtgaatgatgattattattaaatttattttttaattgattgctctcacgaggctcaggtcttagatcagccaatgctcaccaacaatagttctaatcttcctgatttgaatgatttctctgctggaggttcaacctcatctccgatgaatgtccaatcccttgctacccattctactcctacaaatgtgaacttgctctattggaacaacactactaaatcaccctggtttgagtgatttatttgctggaggttcaacctcatctctgacgaatgtccaaacccctgctactacttctacaaatgtgaacatgctatattggaacaacccgaccaattagggtgataagtgataactactagggaaggataaaaaaaaaatagactttttgagtcttcaaaataaaacaaaggacttattctctatgcttcttacctatgtatttgtgtgcctttaggcaagaagtaataatacaaacaggatttttatgtgatttaatcttgtagttttttttaattatatttttagaactcttaactgagggagcttaggtggcctagatgtgactctctttactaaaaattcttcctaactagtttattttgtcgttaagttgtggataatctctatagctaatgtgtttgttagtcgtgctcttaaatcacatttcacactgtaatctcgttgcctccgcttctgctagcttcatccgaaaagttcaagaaatacattaattataattttgaaaaattaaattaattggtatttcgaaatttgataaattaatctggtgtaatatttttcatttattttaatagtgttgaccatataaggggagaagaacactgaccgacctacacttagagatgagatgaatatgtggaagaaaagataaaggtataaaaaagagagaaaatgtgacaaatgacatgatgccaatagaagcaagagataataataaatgtatagtggtgaaaaatgagatggaggaggaaattaataaatatatttttataagaaagagacattagaagtcaagtttaaaaaacattgatgactagactataaacgtctgaatcagtagaaaggccattaggaacaactttgatcttgttagcaaatttatggttttggaaatcgcttcttcgtcttgttgatccagtacgaacttgatttccctttgggatggaaaggaaaatttcaatttgtgaaattgggaatggattgggggaacctcagggattaggtgatgatatatataatgagaagagagcgcaatgcgaaaaaataaaaaagggaaatagagggatgtgtttaactgaagagacgtgaacgagtttgttgataaattttggggagatggttatggggattgaatattgatggaaactattttacatcggttaaaattatatttgatttagtttttttacttacaaaaattctactttgcattttttaaaaatgactgcgtaaaattctttttccggggaaggagggatatttgtttaatttccttaaaattaataataaatatttttgtgaaactcattatttattaaataattatttataagaatttagatatttaaataacagtataaaaaacccatccaaccatttaatacatttttggatccattccttcctccaatttgtataatttgagattttgaggaagagtacgtctatcattttagtgtaatgaccaaccaaaattaattaattaacctaaatacaaggtctgccttaaaaatgatcaagcatattattatatgtaagccttttttttttatataaacaaagtttattaaatgggaatagaagctagaagtactcaaatcttgcagaagattttcaacaattacaactaattaaaaggtataatcaaataaacctttgtaccataagatccatccgagtcctagtaagcaataacaaattcaccaatgtagccattaatgtttagaaatctgttggccaacctctgaaagtacgtcgttaaacccaaagtatatatatcaaagatccttttgcaagttccgatcaaggagctgcaaacagaaacctaaacatgcccatatactttctcaagagagcctcattagaaattgatttccacgtacagaaatgctaaaccagcgaatataaccacacaaaattaatcctagtgtgtattatctagaaagacaacaccatactatcgactaacgtacaaatgatcgacaactcacaaaattaaacctgcttcaataagaacgtaaaaaatagaatagaactagtgcaacttgaatcagcgccctcaattatgtcatgcagtgctagttccacgaccaattaatttaaaattaatctgcataaatttaattaacaagccacgagatttaagtacagctataacatataagggtaagcaaaatcctcttcttagcatgcagccataactacttgaatttttattatatgtatctcgaatatattacacttatacagcttgattttgtgcatatagtaaactctcactgatcgaatatagttttccatatctctgttcgtcttaatgctgtccttctgcaacattaatactgttcacttttgcataaaaaaaatgttaaccatctcaaataaaaaccgtcttctccaatatcctacttcgataacacccccacacttctaaatatgctattttggtatcttaattagatgctattttatataacctactgatttacataaagaattccactaacccataaatcatgccataaggatggcctatacgctcatttcccacctctttaattttaatattgtggctgactggtagtcaaccaatttggcctatatatagtcgtccccacattatcaagattccatatgtccacccaccttctaaatccattaaccattcccacattcccttcaatctccctaactccagagtatctagaaaccaaaaccttttttttaaccttcattcaaaggcatatacaatgtgagtttaatttttatgtatggttctcatactccatatataattatttgaaaattagttatagtataaaaatctttattatattttcacgtgacccttaaaaaaatccttctctttctttttatagtataaatcacctgtatcgtttaaagaaaataataatatttgagtcaagtaagattaatatgtataacataatttttttcttcaaatatttgttgtaattgtgtatttcattaaaatttaaacttaagacacttattaaattaaaacaattttataacaataagtattctgattcggtgaaaaaaccctcctcttctttattcctacatattttatccaaaataatccaataaattctatgtaaatcctctcggtagatattatttaaacactcgttatcaattttaagatatattattttacaaaagccataaattgagtaatttgaattttctctctcaaaaatctgaattttagacatcccacgtgtaaaaacctttttttttttaagagttggggacatatgaaggagcgaaatgcagaatggtgtacgtggataatataatgcagtaaaatattacatttacatattttgttttattttacttttggttctacggataatgttgaagaataattttggcactctaaatgttttggtagaagaatatatgcgcatgcagacaaaagcagtgtccacagatcagtgtttctacagttgcagtacgtgtcccctcatttatttttggcaattgtcacgaatcaattaatacagtaataaaataataccttaattgtttcagcatcgtacatcaattattgacgttgcagttatggatgctcccaagactgagggattatcttcgtaacgtgatactacattgggtctgcgtctggatatctgctcctgtttgtcttcttttgaataatactatatgagattttttataattatataatagtatgatattattaattaataaaacgaatattcaattttggaatttgagttaattatttaattaattttataaagagtttagttaaatttctactacatttatttttgtttaggtatatgtatgtagaacattttttgctcaattaatacaaaactcaattttgtatatctaatttttagagacctcgacccccgtgccacatttttttaaattatttacccaaaggccacgagggtctaactaatttccagagtgccacgcggtctatttcgctgcggcgtccagcgaaataggttggctgaggtggcgccttcctgatggccacctatttcgctataccctgcagcgaaataggtagctgcccaacggtcaactgacgtggcgtggcctatttcgctggacccagtagcgaaataggcacgcagtaacccaaaaagcagggccgtattgccacgtgtcgctgctgtgcctatttcgctggggtgggtagcggaataggccatgtggtccagcataaataccccaccccccgtgctggtcccctccgttccctctttcaaaattttaaattcttcttctctcttttggcttttggtgggtttcttctttggtttttggtgtgaatcttgagtggaatacaatattacaagtaagttttctttatataatttattttatcagcattttggttattatataatgtatagatttttagtttacaacattaggttagaggataagatttcaaacaataggttagacgatatgttgttgaaactttaggatagaagacaagtagtttgaaattaagtttgatattttgtaggatataatttattttgttttgtagatgtttttagtaattaatattttttattgattgttgataaacattagttgttttattatttgagaattttatatgataaaaaatataatttgaatatatatttagatatagttaatttcatttaatgacattgaattaggagtaatttgtcattattgtaattaaatgtatataattattgtaatatgtaattaaatgtatatagttattataatttaaaatattaaaacaaaaaattatctaaaaattttagtgaaacatatttatgtaagtaaaataattaataaaatgaatttatataattagaaaaatgaaacataaacaaatttttataatttcctattagaattagtttatttgttttagtaatatggaatttgaagtaatttttttattttctaactaaatatatgtaattattgtaatttgaatatttgaaatatatgcaaaaaaaatatgatgtaaacattgtagtgtaacgtatttatgtaagtaaaataatttgtaaaataattttatttaattaggaaaatgaaacatacaaatgtttttacaacttactatcgaatttagtttatttgttttagtgatatggatttttacataatttttttattttgtaattaaatatatgtaattattgtaatttgaatatttgaaatatatgcaaaaaaaatatcatgtaaacattgtagtgaaacatatttatgtaagtaaaataattagtaaaataattttatttaattaggaaaatgaaacatacaaatatttttacaacttactagtcggatttagtttttttgttttagtgatatggatttttacataatttttttattttgtaattaaatatatgtaattattgtaatttgaatatttgaaatatatgcaaaaaaaatatcatgtaaacattgtagtgtaacgtatgtatgtaagtaaaataattaataaaataattttatttaattaggaaatgtattatagtaaacattgtagtttaacgtatttataaaattattagatttagttaatttgatttagggaatgacatttagttaattaaatgtattatagtaaatggttcttgaaatgaatatagggtagaaatagtcagatatggatcgcggtgacgatgtcccggcaccggcagtgggtgaggctctgttgagcgtcattgaccctggaccatctgtacggacgttgttgacattgcaggagaggcatatttccactgttgtgtggaatgcgcagagtgatcccaccgcacgggatcgtgtgataaatgttaggcacgccgcctcacatgatcactctgatatacccgaggagattcacccgtggcttatacaggcgggtttttaccatgttgcgcgtttgcgcaatcatgaggtaagcatatgctacgtgaaacgttgcgtgcattatgttcttatggtcgtattgtaatgtgtatataacttaggttcggtctattatttcagtagaccatcacctcgtttcaacacttaggtcataaaacttacgttataataaataactatgtctaacctaagtcaataacaattttctacatcaatatcaaatctcttagacaacaacacaatatatttcatgtaatctaaaaataatacgtttactcaacacttacttgcttacaaatgcatcccaagacaactcatacaacaaaagccttgataacagtttgaacattctaaaaccacaaatgtgatcgcagtttcaacataacaaatactaaaaccccaaagtactaccaaaatggcccgttgataatagttaactggtcttcataacaaccaaattaatgacacatattgaaacatattaaatatcgtcatttcacatacaagtcacaaataaaggtcactgctgctgcactcgtgaaggacagtttcgtctattgtgaccaaccaccttacagtaaccgcatctcagccgagtcgttgacccttcccgcgaatccatttcgttgcgtatgcgtgtagtcgagggccttccttttttacgtctctgcgaaacatctggcaaaacaatgggttgtccagtaggtggtatgaactcttcgtttccaattggaaaccattgagacgaatacaattgacattgataagcaacactgtacacggggtctatgtattgagtgggatcgatttgcgtcgacctgcaagctgccaccacatgactacacggaaacctaaatgcagtaaactcaccacactgacatactctttctgataacgacaacgaccatttctttcccccacgatgagtacgaatgttgtacgactcttgcacctcaaatctattgttttgtgtgtcgtacgaagtaacactatgtgtggcagatttatgaaccgtccgcaaatacttttgccaggctaatttcgcgaaatgattccccctggccatctcttcccgtgcctcacccccgtgctgcaaaaagtatgtcactagtcgagcgtacgtgaaccgcacaagtgaagttataggaagatttcgtgcgcctttaagaaccttgttgaaaacctccgagatgttggttgtcatgtgaccaaatctccgtccctcaacatcgtaagctacgctccacttctcctttggtattcgatcaatccatgcggctatccgagggcctgcttctctaaatttttccaacccaacatcaaaatctaaacgcgacgttgtataacctacatatacaaataagacataaataaaaacacataccgaatgatagacaatgtacatgtaaccacaaaatagcccatggttgcttacctaacattttcaactgtttcttcaacacgacattcttgaatttgtgattaaaattgctcgccaaatgccgaatgcaaaacacatgatatgccctcggtggatgccatcccaagtcgacattgttgaccgccgccaggatgcccgcatgtcgatctgaaataagacatattccatctttctgcgtaacgtgaatacggataagtgccaaaaaccatgaccagttgtcgatatcctccnnnnnnnnnnaccagttgtcgatatcctccccggagacaatcgcaaatgctagtggaaggacatagttgttgccgtcaattgatgttgcaataagcaatgtgccccgatatttcccatacaaatgggtaccgtcgatgctgataacgggcttgcagtaattaaaagcatcgcaacattgtttaaaagtccaaaacaccctcttcaataccctaccacttccgtccaattgcccatcaacataatgctctgttgtttccaacttataagcagacccttgggcaaaattcaacatataacccaaccaccttggcaagaacgcatacgattcatcccaatccccgaacaccttaacgatggccttttgcttcgccttccacgccttcctgtatgatatatgaaatcctagtgttgttgaaatcctttcctgaattaaggcgattgttacactggggtcctccctaatcatttctgcaattcgttacacaataacatgtcaatcaattttgccacgctaaatatatttttaattgaataacaatttaaagtacctaggatcaacgaacatatgaaattcgagtccagctgtttgtgatcctgagagagattaacaccagcgcacgtgtgttcattgttccatatgcccacaacccactcactggaagccttcttttggtatgccctcatcctccatggacaaccgtcgttatgatattgacaaaccattataatccttttcgtatcacttttttcaacaacggcggtccgatgctcagccatacaatattgctttattgccatttgcacgtcgaacttactcccaaacagctgccctttatatagtgcttgacccatctcccagttaggtacttgcgctccttccatgtcatctgcatcctgatctgggtgtgcccaatttatattcgtgtaatggcttatgttagaccaaaatggtacattgccgtctgctatataatcagacattaaccacattgttaaggttaacccataatatattaaaactaacactattaagtaacacacaattacgtgtccgtacctaaaatcggaggctgattttgcattccaacaatccctggagaagggatttcaaaagcacgatcaaaatcaccgtcgacgtccgtgtccgacgagtcactatccggaacaacaccttcatcaacctcctcatcagaactttccatggcctaagctgggtcgtcggctggcgccatttctatatcttcagaaaagctttgctgtgacggttgggttggtggtggtggttgtggtgatggggatatatctctatcttccaaattcaccatcggctctacatttaggtcaatggagccaatattttcgggctcgtgttgactgcttgactgtccaccacaatatacttccgcatacaattctataaatctggggttttctccatcggatgtgcatgcgtctgtaactaaggttacatcatcgtcatcaacaatatccacaccaacccactgcactgggttgccagatgcacatctagcactcagttgagacaccgattgaccccgttgtaaccgtaatttcttgtatatcattttcatcaagtgatgatagctgcatcgttccggaatacgaaacattttgctttctccttcgaacacctgaccttgcggtccaacgtatcttctcccattataatacacaatggtgattaaaccattcctactatcactcattttgcagaatttttcaaaacaactaaagcaataacaaggcaaaacgatttctcgtaacaaaccgtcagggggggtgtgcttaaatagagggggggtgtgtattccgctggcttcagttgcaaaataggttacctatttcgctggtgtcagtagcgaaatagggagaaccaattatttaaagccacgtggctggtcaaacctattttgctactgacaccagcgaaataggtgtcaccaaccagaaaacgccacgtgtcagctcagtcctatttcgctactgacaccagcgaaataggcaaccagctgtcaaagcgcttcgtatttcgctgctcccccagcgaaatccgcatagagcgccacgtgtcctgcccgctgctgccagggcactggggcattggtcagaacggcgccacatcaacaaccctatttcgctgggaagcccagcaaattaggtcgcgtgtcattctgacaaattttttggcccacgtggtctttaggtatagattaaaaatttttgtggcacaaaggtcaaagtctctaatttttatatccttatgcacaagattcattgtatttctatataatatgcagggtgtcagactggtactatatatcttttcaagagtttccttttcatatatgttttttcagatatctttaatttgcactgctgctaaacaattaagaacattataattatatatatatatatatataaattttaaagtaattaattattgttataaaagtaaaaaaatattatcatttacaataatcaaagattaaagtataatataatttatttacaatttaattaaaatatttaattgcatctttttaaatcaatttaattaaataaaataatgtgattttttggtatttgaagggaagtatatataacattgcttagaatgttcaaatatagattttcatagttctatatataatatggtctcgcaaatcaactggccgagcaagattgaagagtatcgaccacatttggactttgaattttgtcaataacgtttttcagatttaaataagtttttatcctcatcaagtagagtattttttattttagtttatgaagttttttttcctattaatccatacaatttttttaaaatcttaatccttgttattatcagataacaatgtgataacgtaacaataatattgacatataattgaaatgtcttgaaatgtcaccttaccaaaaaaaaaattaacgagataattatatgtaattttttttaactatgcttttaattactaattaatttatctgacattatcaattattactattttgaacacataagaaattattattttttgttattatattataacttataagtgtgaaatgttcacccattttctcagtaattaattaatatttgttgaaaaatatttattattttaatagattctctcttttaattatatttgcaaattttaaattcacaatttaatttaaaaaattaaatgtgagtttagtatcaatgaaactaacataatgcagatattgtttttttacaaatataatgttgatatttaaaacggtatgtttcaattttcaagacctctcctaagtcctaagcatgtcaagcagtgaaatttctccttttagatttggttagttgaactatatgtgccctaagccctaactcattcagacccacatagataatagatttgttaacatgaggctcttctgtcgccacgcgttccatcatttcagtctctaatgaattttcctcttcgcacacatcccacaccacgcgcgtgtgaccgttgttttgtcttcttgtcttgccctaattgtacacgtaaaaataatggagaagcacaccacgacacctcttaaacatggatacattttatttttgggcaatagatgtttttgcaccttctttccccaacaccatcatgaccggtggtttctcagtatacacaacgtgttcttgcatgtgcactggttttggataactgccatatttcacaataatctcccattttgcaaattgctagtgtctatatatcgttccattatttgagcaaatgttacaaagaaataagttagaagggctatgtccttatttaaattattatttgttgaagtttccaaacaaaatacaaacgcgcaggcatatataatgcttgaatgtgctcaccactcctttatgattgtatatcaaaatctaggagctccataagcgcctttttagcatttttaaatggaaaattaatgctgaatatatatggtagttgtgggtggtttaattaatttatcttttaacttggttctctggagaaagttttggattgagtgtgacttgatacttactattcaaacttttaagtcggtaaaagtgatattttgaagacttaaaaattaatagatgaataaattatataaatcttattcattccatatttttttatatcttatattttcacatggtattatcattaatgatttggtttggtgagactctatttcttattttatccagaaagaattatttagaaataaatataatatgtctttgttaaggttcaaatgattatacatgaattttgattttggtttcccacaattctttattttatttttggaatataatacagagaaatgtgttgttttggttattgatgatcgtaatgtcaatctagttggaattacattctttaatatgctctagtacatctcctgattttgattaaataaataaatttggagtgtccgagtagataaaaaaggaaaaaaaatagaagagagagagcaaatgaaaaacataactcttccaagggtacaaagaaatttcctataatcaagtatctctgcccctcacaaaattacatgaattaacaaaggacttgcaactcatgatcattaattatctataactaacttgtctactgtaatgataagataattggtttctttgctctataattaaaaatactctaaaacaacttacacaagatgtttattttttcattcctagactcaaacttgtattaacttgaaaattgaagtcctgcctttactatgcacaacaccaaaattaagagtcttaaaggattattatattcggattcatatataagaaaaattaattagtaattaagaaaattaattaatatcatttaattttactaatctcaacaagtaaaaataagattatcggtacaatatctttattgaaacttgatattatgaataaaaaataattttttaaaattaaattgcaattaaatgaatgatattttttaaaaaatataatcaattagagtgaatttagtttgatttgcttattttgagttcaacctacaaagtgacttttttgcttatatttaagtccagaggaagtacaaaatatgcgaccattatcactcttagaataatgcaaaacaaactactcatcaatgccttttgattaagagaatacaagacacgccatcaatgtccctacatcctacattcctaccttgatttcagtactttaaaatttctcttctaagtgcatgtttggattttagttcaaaatgcagtatacaaatcccaaaataaatctaatgggcaaacttaattttattaaaagaagagtctggatgcttttacaaacttcattttgcaccaaacgtctgtttgcaactaaaaaacaaacatatactacatcttatttttcttcaatctctcattttttgcactattttttttcaacttaacccttgagaaaatctccatgcaacctttcggatgccatccatttgtttgatgaattcatcgaaatcccccaaatgtnnnnnnnnnnnntttttttttttttttttatcgatagaaataaaagacaatgataaatgattaataataactaacacattttatttaatcaattgagttaaattgtttgataaatattgatagccgtaaacaactttaacaatttacttgaattcaaaacgttaaattaacaatctaaatgcccctacgtgttttaaacctgttaactatatagcagtacatctctataatagacaactcctacgtgtttatcaattattaaggacatctacgagaaatttatttgatcttatgaaaataagatgtgactctcatgagtaatgagttatcttttaaactaattttaacaagttttatgacatcaacccttatacaataagagtttattgaattaatatataattatttatttatctcattatatcaatctgaatattataaaaaattgcataattaagattttaattttactatatattgcttcttgtatagacattgcctaaattggttgtgtccactaccactgttaatatagttttttttttagtgcttctcacggaacattctatttagattgatataatgagataaataaataattatatattaatgtgtattattgaaattatctagatataaaaattaattaaaaagtcttctatgaacatgaacatttataaaataatatacatcattactccttttgatcatttgaattttgaactaaatcagatgtttcctacacatgttaattctacttacaaactatcaacacgtacggttcgtatatatatatagaaagtttggtaatttcaaccatatgccttctattctccaacatgcagaattagggtgggttgacaaccttacttacctgcaagttagattttgcatgaccccgatgtttgggacttattcacttgtgctccacatcctcctctaccagctgcatcatgtttttaggagtattcccgctaatagcatgaccaggtagcttgtggcccacgtttgccctaacctctgaccatgaccactaccacttgcatctaagggtgatcatgaattcatatgatgccaggtgatgagtattttttttcttctcttacttcaactaaaattatgataggatcatttatttgaatttgttcaaaactcttgataatatataacacagaattaggtaattaaacttaatttataaacatagttggcgaaaacaaattagaatagaagatcttatgcaaattacctctcaccaatagttcaatcctaattaatgattctagtatatcaattttaacattgtgtaaagatttttattatcttaatcctccaagaaaataagactctaattaatcaagaattcgactaaaagatcaataaagtttccgtcaataatcattatatattaccttacctaaaagttttaatattaatttcaacacattaatcatttatattcaattatttgatttaacaccgtgtaaaactaaatcatacaataaaaaatgtatatataaaacttaaactaaggcttaatatatatttgaaaataaataaaatgattataaatataatattatattatgtaaaatactacggtaccttttatctgctatacataattattaaaaaaaattatatatactctttaaagaatataatacattgaattggacagggacaacccaattcaccctcaaattacatcgaatgttaacatcaatatcaacatcaacaacacatttaacttggagtcggtgatagatgaacccaatgataaatcgaaaataagataaaagagagaagaaaaaaaggttaaaataaaagaatggtgaaaggaagaagggagaaaagaagaggagaagaactaaacatgggaacgactggaacatagaattactaataggtttaaccctccaccaagtttataacttttctccactccgtcctaagacatacagtctgtcaatttatatatcattccattaggtcttgtttaactacctttccccaggtaagtttcggtcgacctctacctctctttgtgtctagctcttggtaacaaacttttgttcttacaggagcatccagtggccgtctcataacgtgaccaaatcatctcaatctatgctccctcatcttttcacatagcggtaccactgatatcttttgtcgaatatcttcatttcttatcttatccatcttcgtatatccacacatccaccttaacatcttcatttctactacccatattttatgctcatgttgccttatgtactgaccagcattccaaatttctaaaatttaatctctcaaaaattgccaaatcagatatggatagaacggaatatacccctagttgcatgtaccttattccaaacattcctataagtactcttgattgattactcaattacatttactgaagcttaattatttgggcgttgtgtctatataaatacatttctatcgttgttccatcgctctccatcgcgatccactccgtcattgcacgatgggtttcttccatattaccaacatgtagggtttcaccaagataattagaataatttagcattttcaaattaaattttgtctaaccgtgccagtaagggataacttaattgataggattgaacaatcgtacgcgattgacaaaaatgggttcaattcttaataatagttctagctattaaaacattttgcgaaggaaattgagatgggaagagtttgcattctcataaacaatattttcaggaatactacgactagttaggtaaaatatataagtgtttttagaatttaaaacttctcgaaatatttttcaaagtttaaaggaccagagaaaaaagtgagagtgagaagagaagttaatagttcagatatgaatatttttgtcattgtcattcaaaataagattgcctttcacaaaacttatatgatttgtaaaataaaaatgtcaagttgttttattcaaatacttaacttctctcgatatcttctctaaaaaaagtacttaacttctcgatcttgaatgtcaatggaagagaagttgagttttggaatataataattaacctgacatttcttttatacaaaaaaaaatccatatccacatacatatgggataaaagagatgaataaggataaaagaatagaaacataatactgacacggggttattcttctctttcaacttctcatttatctcgtatatatgcatgtgagtatgaatacttgtaccattcttactcaatttatctctcttttattattatttttctctaattttgtttaccttttatacatacccccataaaataaagtgcaacttcaatatttcacaaaattctcagttcttttgtagaaggtaacatgaaaatcaaatcatgaacccgtagtccgtagagattggcacttggcaagttgtctttcttggaaactagctttcttttgtatttttatcccttgtagctttgtactggtacaccctaaattaagtttatcacgagtaagagagatataaacatcttcaaacccacttaattataaattaacaatgacagttgttaatctgatatttttttacttatgagaatcaaagcaaaccgaaccaaataaccacagtttgtttgtcatccccataaaatcccaatcacattaacatttattgtcacactcactctctccttccctcttagactcattggtagtacgaactagaagtaaccatgtccggtcatcgacgccaaccctcccaagcctttccgccggacctcttcgccgccgacgacctcactaagccctttgacttcacacaaatcatcaccgaagaaaccggaaccgccgccgctgcccaagcctcacgcattcagacccaccaagagatcaaagactctcctctcaccgccacttctccggcgaagagcaaggcgccgccggcaaccaaatcggcttgaaccaccgtatgcaccatgagtctgctcctgcctcctgctgctgcattttatgtctgtcattttctgttttttctgtttttcttttttcttttcttctttcttttctttttgtttgaaataaaaatgttaagatgacagcagagaaaagctcaaggcattgtaacatggttttcttcttcttcttcttcttcttcttctgtgtttgagaaacttcctttttgttagagcttggaatgggaggttttgttgtgatttgctgaccctgcctgtttctatttgaagtttctatcaagatttttttttttttttttatttacaaataggtcttacattttcatcctcatctccgcaggtttatggtttttctttctcttttttaaatactcgtaatgcagatcttttaaatacactattttttattaaaaaaaattataattcatgtgaatcttaagtctttatataaggattctcactcatatctgtagtaaaatgtgttaaaaggacttatgtttttctaatacatgtgttaaagttagaggtttggatctgaaatgtgttgttaattatcgatattaataatgttgtgaatatttcatatacaattacaatataaataaaaataacaaaataatattgaaataattttttaaacttttatttttttagaaagacctaacataaaaataaaaatgtcttacaacatagtttttttaataaaagaaattaaagacactttacatgttagcatggttaaacaatatttatgcatttaaaattttaaataataatatatttataatattttttggtacaaaataaacctaaaagtattaaaaaaaatatttcacatatattaaagataatatataagattataagaatgtgggatatgaacatgcacttttatcatacattgtgtttggtgtggtttacaagtattgaaactagactttattatacattttttttatggatatattatatatcttattgtgggtttgaatgtgacttaaaattttatttattgttcgtaattactaagcaagctaaatatttattaattacaaaaaaagaagcaaaaaccaggcatcatattgtaatttgaggtcactaaattaaaaaggacattactcttaacctcataaagttatatgtcacaatttattgatcgaaatgacaattacttttgttttatttaaaaatcaattattataattatttatttactttagcaaccaaagaatttcagtcgctatatagccactgatgtagcaactaaagtgtattctacaatcacttcaaaaaaatatgaaacaaaattaagtgactgaattagagacaagggtcacagctaccgaaataaccattttcttaattaaaaacaaatagtgactaaattagagatatagattacggtccctgagttagccctttgccaagaaaagtcaccaaacaacagacgaatgagtagtttaaattagcaactgtttaaagttattgatttggtttttgggacatatttttcagtctctaattccatcgctagtatgtagttttttaaatgttagagactgattcctcggtcattaaacgacattttctttttgggacattttttcatttttaagagcttgattggataaatttctttataaatacatacaaaaaggtaataagaaaaaaaattctttagaagctaaaattaacttatgcgtaaactaatttataaaagttctttcatattaacttctccaaaagttgattctcaacttatgcataagatcatttagtttatgaagaaaattaaacatatttggataagcttatcctaaagtaattgtaggaaaaacaatgaaataaacttctctataaggtcaaattaacttatgcatgttctaattactcatcttttagaaaacttatataagagatcttttataaattaatttttgtctataagctaattttaacttattttttctcctaaatatgcttatagataagcttactcaaacataccattatgttaattttctttcttattttattctcttataagtgtttatggataactttatcctaattctaaaacaaaaacaaagaggcaaatgcaacaacttgggagttgaaaaagtcttgatccaacttagtcattcaaatctttattttttgaataattaattagtattcgtaatattattattttttataaaataatataatattgttaaaatattttgatcgttgttttcaatcaaaatattctttattaattcttttgcaacaaggacgtaggtgtcaacatagtttgagatgtatatcctcattgttatgcatcaacactccattttgaagaagaaaaatcctttgtcattaccttaacgttaattattaattaagacattttcttttgtaatttcaagtattaaaacaattattatttttaacgttagctactaaaataataatgaacatttagtagcttttgacataaaaataatatttcttcgattttaagacttaggttaattaattaatactcgtcatttaagagatcaatttaatgtattactggaacttttcaaacagagcagaaataacgacaacaagctctaacatgaaatgtgattcgagaacaagattaacaaacacatcgacactggaaactgtacacaacataatggcaaaataaactagctagagaaagcctttagcaaagagacacccaccattgccaccaaaactccgccaattaagaactctaaaaaacttcatgtaaaaaaattagggaactacaagattgaatcctatagaaaatatgtttaattattactccttgcgtgaaggcacacggatacataggtaaaagcataaacgataagtttgttattgtattattcaaatcacataaagtcgcaaatgaagctttctgatccctccttatcaattgtcaccttgattggtggggttgttccaatagagcatgttcaaatctgtaggagaagtagggggttgggcattcatttgagacgaggttgaagctccaacagtgttgttggtgatgccatatttgatagcattactcataatagaagcataacggttagcatgagtactatttataataggttgaacatttggatttgtgatgggataccccacctcttggtactcatgctccttgaggagtgaagccatgacatacgcaggttcttccgcagcaataagcttgcctctaataaggccagcaaagtgttgaggtgttgttcccttcgagagttgaatgttgaagaaggagaagggaatgttcttgggaggtaaaggtgaaaggctttttggtgtaaaatcccgttagggttcatggggaggaacatctgactcagtggataacatagataggtgacaacaaagttgatgatagaggtgatgatggtggtgggaaagggagggttgtttcacaaagaggaagaaagtaattcagagatttggggcacaatatgcaggacgtggtgtgaaccttttgtttcttttatgacaatttatagagcagtttcaaagattggatgatgtggggatacactaattagattttcatttagatgcacatttatctatttttaagttttttttttttctaaaagtatctcacaattttatgaaactagtttgttgaataattaaatcattaaaggattgtttttgttagcaatttttttgaacaattaatatagtgttgttttagattttttaggggacaaactcacaaatatatattttttgtttaaatatatttttgttccatgaaaaatttatgaattttgtatttggcctctaataaaagaattgaaattcttgaattttgatcgctgaaaagttcatgaattttatatttagtcattgccattaattacattttctttattaagtgttacatgtttcattagttttcttttgtctctgattttttttaccacaattgtgggtatttttccatcaaatgacgacatttaattaaaaatattatatataacaatttgtaataattaactgagacttggtgccatgtttttctgcttagtatgttaaacgttaaaggtggttgagggtgacggggttggggcgatagagggtattttattttccaattttaagctttcaatcccatgcattatattaaaaatattacatctatcagtctgtaataaatttttttgatcatttaaaacaactattattttgtaacgttagctactaaaaatattgctcatttagtaactttggacataaaaaaatatttttaaaacttcaagacttaaattaattaatactcgtgatttaaaagattattttaatgtattactggaacttttcggtcaaagaacaaagagaacagaattgtagcacggaatttgatttgagaacaagactcacaaacacatgcactagaaactatgctcatcataacaacaaaataaactagttgaagaaatccttcagcaaagtgaaacccaccatgggcacacaggcccccttagttaaaactctacaaacttcgtgcaattttttttatacgattaaatctcagagaaaatatgtttgtataatttctccttgcttaaagacacgaaaatacatagataaaaaagcatatacaaaaactctattattgtattattcaacacgttttaactcactcacacactttttgatttttttttttattataggactgacgggacttccctattttttttatatagtaaagaaatctgattttaaagtgaatattatgttttattagatttttactatataattagtttttatttcttaatttttttaaaattataaaatcgttaataatattatttttttaataaattttatcactattatattttatcaaattttagttattatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaatatcgggcaggtttgttacaatttttttatataaaaaaagtaactttgatgtaaaataaactgatgattatttctttctttctttttttagagattttaaagtagcaaaatctaatttatgtttgtttacaatcatagaaaacatttttgttaaagaagcaactaatttaatgagtagttattcaaaataacttctgattttaattccattttagattttttttttcaacttctgatcgttttgaaaagctgaagcaaatacacacaannnnnnnnnnnnnnnnnngatatatatatatatatatatatatatatatatatatataaaagaagaagtgattctttgacgaaaaatactgtaacaaacagacccataaattttgcaattcattaataaatgaatcattattttatatgttatgtgaattataaacatgttttattttaaactgcaggctaaatgagccaacttgtatatgagttgagttaaatgggttggttctcatcgagctcaagccctcatcagctatcagttaaaatggacggttcgcatatcataacccgtttacccacctccaatcaccacatgtttacatgtgactttggtattagtattaatggataatataaaaagataaaattttctgtacaatacatggaagatcacctttttcttactgaaggaagataatttttgttatttcttttaactaaaaatatctttttaagttgcatttatattagaagtgtaaaaaaatcaaaattttataaaacttcatagaagaagataaagtatatgtaccagttgaaactatttgattaaatttgaaaaaaaaaatcagcaagctcacatcaaagatcaaactaacccaaagatcaagttggtatactttggcctatcaaattgatgacctattaatatattaaaatctcaatttaaggtttaggatatagagtttagaatcattcataaagaaaaataatatggtaaaaatatataaaaaatccttaaatttataatattaattaaaaatatatttgtctaggggattttttaataaaattatatatatatatatatatactagttagagtttagttggtttaattttaaaaaatacgaatttgtgtgtgaaaaataaagcaatttaagtagtcaatgtttggtttaaaattacaaaaatactttttcaaattttaatataaaattgtgttctaatgtatgaatcgagaaatatttttttttattgacagatattagtaattaataagttatagtaaaaagatttaaacatataatttatttattactctaatttttatgtactttctcaattatcaaaccaccttataactctgctaattttaaaaaatattatttttagagtaaaagtacttttaagctcctaattttaattgagttaaccaaatctagtaaacacatctaatgtataaaataaaataaaatgtatataatattaatattcaaataataaatatcaaaatatgagaaatttcttatccaaggcaagcataattgggcgaacattgtcccatcccattcccatcacttgtcttcacttgataatcacaatagccaataggctttcctatattacaaagcaaacttctgaaaaatggtcctaattaagaggacaaaatgtattaataaagcaaccaattcatagtcaatatcaacaacttcgtatgggcccagttccgaagccaataataggctttgtttgcttgatctaacaaaattgacgcgtgtcgtattttcgtcctttgcacataaaaacatgaatatgctttttcttccttaagcaacactactacagtaaccattatctcaacaacaacaacaacaacaaaaaatgtacaatttctttagctgaaaacaaattatgtatgattgatgatgtgcctacgtttgattattgtttcttacctaaacctcactaattattttccacttaaattcagatgcagtaacgttgacaattgtgacagatgttttgcaattttgattgtgcaaaaagcaataacgagaacaatttggacgtggattttggattccacatactagatttcgttgtctcctctgaactgttttcacgatgagctccatattgtgttgacaaaattggtgaatctgccccaccatccaccagaataacaatagtcaacaaaatttggctcggatttcttagcctttgatcatgacattagtttttaatggaaaatgtatatcgtatattgaagtagaatggtgaatatagtttaaactctcagtcctctgaagtattaacactgtgccttcttgcaatttaattagccacacaagtaatataactactgctatcagaaattgcacaaaatggattaatctcataaacaattttttttaattaatcatttgatccttacactttgtctcatctttttatttagattgtatatctaaaaattctctgttttagtctatttattcatgcaattttttttatgttttagtagttgtcgattttctagcaatataaaactgccacagagtagaaatataagaattaaaacataaaataattgttcatatgaaaactaaaacagagaatttataaatgtaagaataaaacccatatcctcttctaccggctcaacattgttaattgagtcacattaggttctaaaagaatagcttttactctgcatatatctaatcctctttacaagagttgccattttttagtacataaacatgctttaaaagtcactgattttaatggtatagtaattgacaaaaaccttgccatgattacactatagaaaactgatgcatactcatgaagcattttttgggttgcacagccatgagttaagcaataaacaagacatctaaaacagaagattattttcatcacctaaagtgcaggtcaaacaaaccaggactaactaaaatctttaataaatatcactgaggaaattgaggtaggtacctgatgctataataattaaattctcacaatctcatatgcttgctattttcagcaccaagaggggtgatcagaagaatgctctactaccataaaacacacgtgatccatcctttttcttcttatcaatttctaatttgctgctgtcatgattctgaatcacatcaccatcaccatgatccactttttcaggtttgtcaaggtccattgggagcttcatttttgccaaggactcagtgaactgctgcatgctcctcatatacatgtccactatttgtttttgcatagcagcttgctcagcttctaaattgatgttccctagtggagctgaaaaaacttgaccaaactttgcagcttctgtgttgttgttattgttttttttgctttccttttccttgcttgagaagtttgcatctttgtcatttctggcatcaccttcttctttcttggaagttggggtatctggaccagcaccacagttttgactaccttccacagttattgacacagtgacagaatttgatgagtcaccagtgctcaaatggttctttttctcaactgaatcagctgagtttctatcatcactcaaggttgtgatggtggagcctaggaagcaagagttctgaatgctctcatttggagaaatggaccctacatgattctcatcttgtgaactcatagtcatctcataatcatcaagttgaggagatgcaccaaggtgaagaaatggtagtgaccctccaatgttggaccttgaaggagcagaagtagtaccttgagaagccaaattgaagtactcagataccagttgctgattctccttcaccacactgatgtcaggaaactcaattctagcatactcaactgggtccaacataacttttgaggtctttctatcaagcaaaataacttctgatgatattgatgagttctttgctgattcagttatcaaattcactgatgagttgattgccaaagaggggtccaaagacagtgttagttggacagttcctgcaggagagtggaaaagatcagtggaggaaaggctgtaatcttcagtcacctttccttttccaacaacttgtgaaattgggaccaaagcaaaccccaaaagctggtcttccatgtgaatccttgacctactaaacatccaaacttcacatttcagaacagcatctatttgggtgatcttcatcctcaagttttcattgaatgttgggtttttgccacctccattgatgattcttgtagagagagtctcatcagggttgtaagtgagagagaacttagcatacacatcctggttgtcatagatgcatatgttatgaatattcctggcatgatggacaaagatatcaagaatccctgagaactcagcttcttcatctgcatgtgtccttgtgttcaaatttggattgtacctgaagctggaattctgaacactctgattgaatgaatccattccaagttccaacctttgttatgccttggaattttgctttgcaaccagccagaaggtttccaaaattaggaaacgcgagagaaaaagagttggtgttgatatttggatcatcaatgatcaccttttggatacatagaagaccaaaacaaaaaaaaaaacttgattatagaacaagctagaaatcagtggaaagtagaaaaaaaaaaaaaagtatctaaaggattaaacagcaaaagaagagggttttctcacctagtagaatgaatggtaacaaaaagttaaataacactagctctctatgtatgttggggtgagtatcttgtagttgaagacatttgtcaaatcaatccatgaattcaggaacaagcatggataaagatagagagaaacttggagttcaatgaagtggcttgctttatggaatggaagtggggtttaaggaccttgtggtagtaggtgaaaaatgaagcatggaaatgaacagagaagagtattatgatgtacatgtttgtttggatgccacttttggtgttgggtttctttgcttcacaatgcagcttccatatatctctattctctatctagtgcatagcttgctccactgatgacactaatgctattggaggacccacttgccaccatcttcattatcactctccccgctcttcaattgatgctaccctcagctttcagacaacataaattgccttgtctctcaagggctattggaacaaaaacaattcatctcctattggaatccgttcaggtcaaatcatggaaatattgagttaccaagataacaaaaaatcttggttttagtttaacattctaaaatacactttataatatttatatatatcatgcgacaaaataccaccattaaacccaactaatgaaagtaagtgatttccccgtattttgtatgctttttttgaagggttagatctttcttattttaacgacgtattttcaacataaaactgtgaaaataactagtcctgttaaatttctcctaactaacctatctaatttaattaaatattataatttaaaacttcggtgagttaaaaagaaaacaaaaaatgttgtgctttaatatcttcctgccttctgttgactgacttcttatgtttaaatatgtgaatagctaataaatggaagtaatttctttttaactcggatattttcagtcgagaactaaaaactaatcaattgtttaatggaagtagtttagctaacaagaaattaactattttgttttaaaaaccataaattccattctcaactactagtacgtaattccccttagaaagttttcatgtcctaactttgataaggaagctttctccacaataaactttttgtagttaaatttaaggaaagtgagcaagacaacgagttgttggaaattcattccactttgttaatttgaatgattatgcaaaaagtttacgttggaagtcttggattcaagtccgcaacatgtggtatatatgagcaatgagggtaacaccagaaatcataacctttgactgctaatttgcctgtttcttttccctacatggagccatattggtaatagcctctctctctctcgcacacacacacaaacacgaaacactacaagctcaaaaagttaccgattaaaaaagaaagagagaaacacgaaatttagtgggaaaaaacttcacatagtgtcaaattgttcccacaccccatgcatagcaagataagacgtcatgatatagacttccccataatttgttaattgtgttatttccttcttccatttcgtagtggatcacaactggtatcactttagtccttcctaactacgttgtaagttataagccacaacctaacaacatcccctctcttagacttttggtcctcagtgccctaccaaaattgcaatttgcaattaatctactagcaataattttagttattctctctttatatatatatatatatatatatatatatatatatatatatttacgactattatgggaacatttttccatagtttgcaataagaagttttctcaagaatggcaaagtttaaaaataaaataaggaaccaaaaacaaaaaataaaatagtcctgcatttttcgataacaaatcagaattgaaaaataaagtaattagctgtattgaaagcattcattttgacaaaggggatatatcattttgatatattcatatcaaattacttaattaattctgtttaaaaaatcatttaataaattaaaaaaattgtactcaattatattgtttgatgaatgttatgcaaatcttaattagatagagaataaatataatttatatttaatagaaattaattacttaaatttattaaacaataatggatgttttcttagcatttctcgtttttataatctaatcaattaatggaaagtctcaagatttattttttaggggattaaaatttgctttcattttgtcatgtggaaaatcaaattgatgccaaatttattttggcggtaaaccaaattagagaaatatatctatctatttaagtaaactagatttgaagaaaaaaaaaacactataattttaaagaaatattaatgtaatacttaatgctattaatgtaaattttataaagatatgtaaataaatattttttttcttatatagtatttaataggttaaattaatcttttttcactgcaggttaaattaatatgtaaatctctaaatttgaaattttttaatttgatctataagattagcatcaacaaaactaaaaagagttatgctcaatggtaatagaaattgttattaagcatttaggattaactaatatattttacaaagaattgttaaaacttaatttccactaccaaacgcctccttcttaaagtgatctattaacttgttaataaggtatttaaaaacaattctacctagtactttattgaaaaagactatattagcttatattctaccaaaatttaatcactatagtctaaaatctttaaatatttttccatcccttcagatttcttaatattattagaatgatggttttttattcccttttctctgctcggctccaaatatttaaaattttaaacttctcttctcatttctattcccctacaatcaaatgttatgtttcttttttatttgttttttctgtaatcaaactaagaggaagaaataaaacaagctcgatatgatcacttgttgggctaaacccatacatacacctacaagaactcttataactttaggacgaacattttatttggatcttactatttacaccccgtactcccctttctatctcttgattatccattataccctttttcttaaagaagtacacctcttttacattttagaaatgtctttctagaattacatatacatatttcagaaatgtatctctagaactatgattcatagtttcagagatatacttttagaataagtatatattttttttaataaaataccacttaaaaattaagatgattgacgaaaaattaaaaataatgataaacgcttattttatactcatgtttgttggtcttattttcattctatcattaatgttctttaaattttattttcatcttatctttattattgtttaaatcctaattttaaattatttatcatatattcattatataatattacgctttcatcattattatataatattttgtattttccttcatgtgacaccttttcaaggtacattcatcactaacttcatacattatacactttaattataaaacaaagcttttgaggatggtttcttttctttcattcattttttaatttaagtctacgtcaatgattcaatgccacacagagttaatgatgaaagtaccttgaaaaacattgtcaaattatggaaaaataaaaatattgtataataatgatgaaacgcaatattatacaatgaatatatggtgaagatagtttaaaattaggtttaaagaaaaataaagataagatgaaaataaaattttatataggatttaaagaacactaatgataggatgaaaataaaactaacaaacacgagtataaaataagcgtttatcattttttttatttctcgtaaatcatcttaattcttaagtaatattttattaaaaaaatatatacctattccagaagtatatctatgaaattatgaatcatagttctagagatatatttttggaataggtatatgtaattctagaaatacattactagaaagtaaaagatgggtgtacttagtaaaaggatgtgtaaatagtaagtgccttctttttaggccataagggctatcggtacttgtgaatggctcgtttaacagctccttatccgtggggcaaggatgtaactacataactctaaaaaaactatatataggtagagtaaaaatatatgatattattcttattgaattagaaaaaatttcagtgcgttatagttttgtttttatggtaaaattttaaacacggtcaataattatttatttaaaaatcttaaagttttgggtcgaaatctatatcaaaataactaaaaaaaatataaaaatccttgtgaatgtttttatcattttaggtatataacctactttcactgaattggaaaagttaataaaaatatgcaccagctcggctccaagaccagtattacattgtttgtaagaaggaacgactggaaccggatccctgcagttaatttttgaactgcatggcgcagttataaatctaaagttgaagtttttaaattgttttatcatttatttcaacataaaaataaatggataaaatatacttatagtctctataaatataatttaatttaatttagttcttagaaatattgctaattttagccttcataaattttattttatttttaaatcaattgccatcattatttactaatgatgtaaaatacatttagacatatcatgttacatatcacccccggaataattagttatataatacagctagatgtatacgtacaaatcaccactttgtaatgacatgggctatttttttataaaaaaaattacgagaactaaaattaataagataatttttagacacaaaaattaatcatatcaataagcacataaacattttcaagcaaaaaagtaattgcaagtagatgaaaatactacagttattttataattgcaaatgattgttacttggaaatgtacctagctagccaacacattttaggagttatacttctttctctttctcaacacgtttgctatcttcttttcttttagcatgaacacaaatgaccaagtgtgtgtttaatttagcatctcaaattcacatttgcaggtaaatttatgtttaaattgtattaataacgtagaactaattattatttgtgttgaaattgacatgcgttttctatcgctcatccaaacacacggtaaaacaaatatcattattttaaaagaatgaaataataattggggaaaactttttaatactctaaaagattagtatgccatggtagttaggcctactagcaaagaatttgggattttgtacgaaatcactatcacagtgagtgaagcaacttttaatggtgtgcaattaattagaaagtcaatcagtaaactagcatgacaaaaagaaacttttagaatgattctaatcaaagcatggaatttgatttaaaagtgtgagtagcacttattggtgcacatttaaaccaaaagttaattttggttctcaacgattaaggcacaaagccgatttagaaagcaattcaagatgctcaaagggccctcttttgaaagctctccgcaatatcttgttattgtattcagtaaaagctttcttgaagccagaaaaccaaccgtttaaataatgttcgatgcacaaatagtaatgtgcatttagaatgtctgtataaaaaattcttacttaattatcaagactttcccaaatacactttttccccattttgatggcaaaaaaagcttattcctttcctattttttcctgttccttttatatcaataaatctttaattttttcaagtcacccattcacattccaaaataataataattttgaaagttaatttactgataagcttttataatgaaagagaacaaactagtgacctaggcgtagactaatatagacaaagtttataataggcatgtatggttattaatgcagaagtttttccaatgtgaatcagtcaaaaattattatttttgtatgattttatgatatttaaagtaattaatataaaaatggttaaattcgatatataccaacaaaagattagatttagtggaaggtttaatctcttacaatgagagatacattaaggtttaaatgttcgtcaaaaaagatgttcatattaatgtacaatcatatgcatgtcttgaacatgaatatttctcaaggaaaatatatgagaaaaaaaaccaaaaaaaaaaaaaaacttatcatttatataacagtttataattagatgaaaatattaaatatttttaaattacataataaaagtattatttattcaaatagataccataaaattttggatgttgactgtgatggtcagctagcagggtggtattttgctgaaatatacacatttttttcttaaacgtacttcttgcggttttgttatcaacatattttttccatacttattttcctttcattatccgttatgtccaagaaataaataaactttattaaaaaaaatcataatgaatatttttacgacagtggttagtaaaaaaaaaaattacgtactgaaatcacatgtgtttcactaaaattttaggggggaaaacaattctttcatatttcaaaaggagacttatatattcaagaatgaattctcacatattcttttgttttgtaactttccatgtctctcttcataaatattaatttacaaattttgacaaggcccgatacattcagtatttatatataaaaaagaggatatgaacaatttttaacagtacaaaattatgtaaaaattgagagaatattcaattccattacactacacccagtcacccactacccaatgtgggtaaaaagcttggcatggtcagagaattaaaacttaggagagagatggagaaaaacatagaggcatatgaagggttaaaaaaaatagagatctaaatttagaattatattattcatattctacttattataatattatattattcatacctttgcaatttttaatctgaccccaaatcctgttcacatctccaatcttgagacaaaaactcaatcaaccagaaaagggaggtttcaaatgggattttagccagatgcgtttataccttgagtggttttcatacgagcattgtttaatttatacgcttcatcatatgctggagagaccaaactcaaccaacaagttaaaaaggaggcttcaaatgtatgattattcttcgcatccctagtttatagaccaaaaaggaaacaacatggctggcccttaagaaaaaactaggttgtgcctccacttatgaagctaaaaaaataaaaaataaaaaatcctagaagaatgtcctcacaatctataagctcttttgaggaaagataggaagaaacatgtgattagttctgttaataatttgttttaagagataaaactatccgaaggttatactcgttttttttactgcaagtataaaatcataatagtacatcaacacccttatttatccacctgaattttgttaatacaaatttgagaatttgatgtgttgtgtaatgattcagtttttattgaatacaatattaaagaattttcaatcactcataaattatgttttaactaattgagttagatcttttttattatgtaaaagtttggttaaacgcatttttatttgtcaatattgaaaaaaaaacaaacaaaaaaaaataatgtcatacactgttcaagatatttagattacacagtaaatactattataagtccagcaacatgtatacagtacattttggtagtttattctgcaggcaaaggttatgcttattagtttctatacataataaaaaaatcgcatattctataaattgcttttaaaactcgaatacattcattacttactttcaatcattcgacaaaacacacttatatcgtgatctgactgatctctatcattctactttccactataaaatttgtttaagtatgcttatatttttcctaccccaccactttcattaactactaattattgaatgttcacacaacaaactcatccatccaacttttttcataataaaaaaaatctattttttaataatattttataagaaaaatcataggccgtatttatacaaattcacgtgaaagttagtttgtctcccattaacaatgttggaaaactttacacctctctttcttctagttctttccctttcgtacgaaatggcattgagatgccacatgaacattggtattggcatatgatagacaggactatacctagtgtttaggtgtcaattatattttgtgcaggttttattgtccttcctaccatatatggagctggtgcccaaatacccatgtatgatagaacctcgctatttaaaggaaaaattgcattggaattgatcgacttttcaatttgatgtcaaagcatgttttgaaatcggaccaaatgaccacaatcatgagtgcagactggaaacttttgcttaggaaatgaaagaaattttgttcataatggaaccatatcaagaaaatcttctcagaaatccaaaaccgttgcagactttgaatggtattggaaatgctacaactttagtacatgattcattgcattatatttggaagaaatgatacccctttaattacaaactcacatcagtatatattattctcttttcacagtatatatatgtatatatatatataaatttgttagcatacaaactcctatttttttaaatatgagcgtattaataaattatataatcaatgcattataagataatatctgcttctagtttgttaaaacactcatactatataataagaatgtcaatcttaacaaaccttattaacatttactaacttacacatttttattttttaatatgtgtgtcaacaaattatatgattgatgtattttaaaataatatttaactataacttgctaataaactcatactaagaaataggagttagcaaattctccctcccacactcaaacacaatatatatatatatatatatatatatatatatatatatatatataaccttaatcacacttaaaagtttttctccataaactatttacaactacactcggttagattcttatcacattatactattatttattataactatattttttttatctatgacattatataacttatcatatatgattatattttttcttattatttctttttctcactagtgtcaacacatgattaaggtatccacaaatcattattgttatataatgtgtaaagaccaaataagttaaacaaaacttcataaaatatttaaccatttctaatcaatctattttcatataaaatatgctacttcttttaacttatcaaccaatccaaacaaaatcagacacctgaccttaacctactgcacaaaatcaaaagctacgcagaaacgcataagacaggatacagttaatttgcagagcatacagaaccattttgcttacaatttacaagctgcaacatccacacccatgggagttttttgtttcatagaggcttagcgtatctagtaaaaacggttttttcacactagaattaaactaaatttattctacatgatcttgtattaactgtcaaaaattatgtgaagtgatcgtttaaaagaaaaatctgacatttgaaaaaatcttacatgactactgcatttcaatcttaactcctacttctataaaaaaaaaataggattaataatcttttattataatttttaatttataattaatttaacaactcaattaatcacaatcaatcattgatcaattagttaataatctataggtgtgccaaaattgacaatttataaaggacaaccaaatccaaatattataattaaaaattaatcaaatataataattaaaattaagaagatcaaaatcatgaatttaaaattaaaaaattaagaagaccgaaattgtattttaataaaaacttaaaaaaatattagaatgtgtaacagactgcatctccgaaaattattgcaaaaaaaaatttaacatgcattttttggggtaaataatataaatatatgcattaatcctaaacaaatatatgacaaattttgtcaaacacggtcgattctgccattctagataaattcataaaggaactgttccatacaatcacccaagaaactcataaagttcaattcaaaataagtgtgcctggaataattaaacggacacaagcatcctgaacgtatacggcacaaaaagtaaaaataacacgatgaaataaacgattctcaaataataaatattataaacctagattgtggaatcaagtaatcaactaagcactgaacaatcctttactatatgggcacaaaagaaaaattccacacattccaatcacttcattaccacccttatatatggactaaaaaaatacaacacgcacactagtcagaataatgacacgtttccttaaaaaatacatggtgaagaatatgattgtagctgttaaataatcgcatactaaaaacccagggaatgggagaaaaccaagtaacagaaatgactttacacgaactcctatataaacaatcgtagaaatcactagacatttggaacaaataatacgagcttaagtcagactatggcagagccataatttgatggaaaaataattcactgccacaagcattgtgagatcacaatacaaaacaaaagcaacaaaatttcggaactgcaaagagcatgtcaagaaattaaactgacaaaaaagcacaaatagggcaaaacatgaaaacccagtatcaaaaatgcatatcaacatgtgtaacagagacagtgaagaaaattcaagacaaaatgcataaccatgtgcttaaattttttaaatggaaataaaagtctcagaacatgacaaaattaagacatgataatggatcacaggcagcaacaaagcaaaagggggcacaacaaaattgttcgcagaacatgactaaaagcagacgcataaaactctagtgtacttaaatgtgagcaattcaagagtagtgtcctcaccagcacagacatgtaccttaatgttccaacataattacaccaaccatgtgaagctgtatcaaataatagtttctaccaaaaaatacccaaagataaagggaggccccccacgcaaagaaagaaaaactagttacccaatcattcacaatggagaagaaaacaaatgatagtgctaacatatttttacatatgctcccaaatcccagaaaggaaaaacaatttgccagcacaagacaagctaaaactacccactagtatcaacattctaaatgcctgctctagggcacaaacaaattgttccaaacacaacccttaaatgaaattaactaaagacagggtaattaattctacatcagtggaaaagtaaagtaaatgattgcttttttattgacatgataggaagagttagacagatcagcattatgattcaagaaatatcaccacaaaaaaaaaaaaaccactggtacaaaaatgtgaatgcattgtccatattagtctattaatgaactatcatagcatgccacaacacaagcaatcctatgcttcatggatatttcatgagtgaaatatgtagcaccatagcaaacacaagacaaacaagatatatatataaaaactgtattgcaatccacatgacataatcgtcctaaatataaaatatattcagacaactaaaagggggcagcatgtgcaggaaaagataatctaaatatgcaatgaatagagacaatcattcatttgtttatcaatggtcggaaaccgtatctaagaatctagccaaaaaaataagtgacacatctgcatcttctccggcaatacagtatataaaagctgagaatgcaacctcgacatcaacttatcctgataagaaaaaataacatacaaggcaagttctaggatatccgcatgctatagaataatattacaaatactactattaaaatcttttagaagagaaaggaatggctttttaaatctaaaatgggtctagattgcaaatgaaataaatgtgacaccaactcaagctgcacatattggtatttgaagtttagcaccatagtgcaccaaaattgagcaacagaagaattaaacagctttaattttggctagagacactggaaaaccgactgttattgttagaagatgaaaggttcggtaattgttattgcctgaactacaaatcccaaacaaagaacaaaaggaaataggagttacattaagtcttcatgaatgcagaaactttgcaggtttctcacgcatcagagatgaccaataaactaggatgaaaaggacagacatacattgacggtgacgttacaacaacttctaatgctcaagtctaacacagcagctacttgtaaaatcaacatttatttattccacaatatttaaaacaaactgagccatcacaaagtggcaatttaatattagcatctagaactaaggaattaaataatgtattatgtttatgtctattcagaaaaatcgaagcactccaaaataacgagtaaataatgctgaaaaatacatctggaacgcaaaggggtgaaggcacatcaataacaattatcagaagatattaacacatataaactcatctttatcatacgctttatactgtagcaattgattgtgggtataatactgtagatttcacctttggcaaatttaagtataaaacaatgaaaataaagggtgagtaaaatggaaaacaaaaggcatttgcttcaaaagaaaagttgatataattgttgcaagcttgcaatcaataatgttaactaaaaataaaatttaaaatagtgaaccaagtaaaataagttttaatcatctttgctttccagtttgagttaaatttagtacataagaaacaatttcttttaacagttagaagatagtgaggcttcctagtcactaactgatgatctcatgcaatgacaagggccagattgggcgagagaaagaattatagaactaaaatcaagttgaaaaatggcagacagaaaaacagtgacatatgcaataaaggtacaaagcctagaagaaaattaaaatatcatcagcctctccaagcccatctactaatatcttgcactcggaaagacacagtttttcagacactttcagatcaattcattggattaccatatgctgaagaaccccctagtaaccctccaccagaagctgcataaacatcattaggatccaccattggagatgaagatgaaaccccatttcttcctgcaccaccacttccaccattttcaccacccaaatgcaactcagataggttaggatacacatccctattctccactccttgatcatagagaaaccctttgaacacgtggccaccaatcttcaccacagcttgatatgcatactcatcttgcccatcctccactgccgtcactcttacacacttgaaaaccgctggtgcacgtacttgcccaggtaatgactctttgaaccccgcatctaatgcacacaattcaacaatacacatcacaattaaacaaccttaaaaaccctttcaactctcaaacccatgcctatgcaccaacccaaaagaagctaatgcatgagttttttttttttccgagagaatcgaagacagtctcagaggtttacaataactcatgcatcacgcaccctgctcaacggcagacccccttgacgctaatgcatgagtttatgttaatatatgtgtattcatgcaaaataaaatcatttcattattatgaaaagaaagcacaaaccttgatggctagagctagtgtcaaagcttctaggaggggtggtgttggaagtggaagtgtgggaggttgttgtggtttgtgaagcaatgagcctaggttttttagtgccggaagtggagccactggagccggcgacagccgcggtggccgacgtcattagctggcgctctctccggcgtgcggcggggacccaagtgctcttaacgtgggtagggcaatcaaagcctcggcttttgcaacaggttctgcaccttctattggtacaatctttctttgcctgatttccacaatcttggcacgttgttccgccgctactagttccagaagcagttacctcgccactgttctgaaccaaattccccgaactggtgttactattatggtctagaagaccctgctgcagctgcttcttcatgtagtggctttgatggtgttgttgttggtcttgccatagctgaattcccccaccgccacgtgtcctatttccgaggatgttgttgttgtcggattccaggcacggcgtggcggcgaggagagggatgacaccgacgccgagtgcagtggcggggttgagggaatccgccatgacggccggatcgtgttgcggcggttggtggtggtggtggtggaaggaagaagctggcgccaccacgaacatccccatttcggggtaattgattgacctagatgcggtggaccacattccggcggtgggtccggtggcggcggcagcaggacccgcattgaagccgagggagaggtcgtcgacggggacagcgcggccggcaccaccaccagcaccggaggaagctgtcgctgcccagtccgcaaaggcaccagaatctgaaggtaacctccttgtagtagccacaactgaaaatccttgattacttctcaaatcaagnnnnnnnnnnnnnnnnnnnnttagtaaaaaaaaaaaaaaaaaaagtggggtgtatagtaggtggaaagacagaactaagtgtagaactatagaactatagaagcatagatcttctattgtctaagtggtggtgtatatatattattttgtatgagggtgtatctaatgtgggtgttattcttcttggggtggggtcttgtggcagggaaagaatttgttggtggaggaaaagaaaagagagaagttttctcttttgatggagtttagtgtttgagatgagatgagatcttgttgtattgttagggtgaggtggggtggggtgggggagttgagtggagtggacttagatttttctctctctatgaaaaggaagggaaaacgaacaacttctctgcttcttcttctgtttctgctgctgctgctattgtggctactactactactgtcactttggcttttttccacaggaagaaaaagttttggttcgagtaagaaagagagagaaagaaagatcagtttctgaagggtccagccagcagaagagtgcagagagagcagtgaatgagaaaatgcaataacgacttcttacttactgtgtctctctttctctctctctctctctatctatattttattttctttctctctgctttgctttgttattgttgccgaccttttctctctcttcatatcatcatcatctctccttccttcgcaaacctagctaagcttctttttcttccaatatttatctctcagaactaaagtcctttctttttcttggcttcctatgaaaagtgaaaactgaaatgggttcttcttcacttctcttccctaacctttctttcttttccaattcccacacacagactcttctctctctctccaattatcaggctctgataattagtagtagaaagagagaagaaggggaagagagagcataaagacttttgttctctagtttttgtaattttatggaccctatatgaaactcacatgacgccacttattacttgtgggctcggcgcgtgagcatcactccccgcgcgtagtgcattttctcaccccagaatacctacacaaacaccacttacgtctcaatcccacttcacttggaacggcgcgtggacgcaactacgttctatctgtggcacgcatgtaatttgggacgttgtttatttttgagaataaaattaaaccatgttgttgagtagcactcagcaatatactgtagtctataatctaaggtgtcatccatatctttttccttttttactaagagagtccttccaaccccatatctatgaattctttttctttagatcgtctttgtcagatatcaatttattgagtgagtctctctttaaattgcacacaaagagtttttctgtgatgtttttttttttttgcaatttatgtgcatatgctcagatgacagttaatcgaacttaagcttttgcttattgatttagttgttgttttttatgactctgtcaaaaaaatggttgaagattagggtgctgagtttatgtgtatatatttcaataagatttccaaaaaatacacaccggctcttttgtctgtgtccagccatttattaatacttctttacctgtatcaattaactacataaaatgtgtaactaaataaaaataaaaatagtcatagttttcaaataacttgttgttttgacttcataacaaaatactgatggtcttgctggtgttggttgttgtgtacctcacattattgtaactagacaatagctttctagactttggcacttattaagcttgtatggaagctctcactgtattgaatctgaactcaagctttatgcttctcttcatactgaaatcacacaaaaattaaggttttcactccaatttttttttttttttagaaattgtgtatatttcgtcagcttgagtataacgggtaaattgattaatacaaatcaaggatcttattaattagtattcttaaaatattaatcgagaaactaaaaaatatatattatataaattacaaaagaacttaaaaaaatataaataatataattttttgtcttttaataaaaatatttctattttaaatttttaattaatacccttagttgtatttttttatatcaagaaataataagatgacacgatatagtacatgtataccgtttttaacgttctaaaatacatttcagggggaaaactaaaagagtttcttaagtacttttatcttctgccctaaaaaaagtatttttatcttccttcagtaatccaagttaatatacgtatagaagctattttgttagggtagattgttttggttatcttttttttaaatatatttttcgagttatcatcatacttctttaatgtaaaatttatttcttctaatatataataatatattttttcacaagtgagacttactatatataacttatttttgttttaaataatttactactggttttaggaagggaaaacacaatcccaatgaaacacttaaaaatgagagtgtgttttttaaatgaataaaaactaaaaaaaacttttataaaaactaaaaaaagtattctatttgatagtataaaaaaaattgagtaacaattcatccttttatacttttctcaaagtgttatagagctttttttatgcaagaatagctcttaatgatttatctataaaacaaaatacttcttgcatgggaggttatggagtgcttcggttacttcaagtaaagtcattacatttgtggtggtatatgacagtttttgcgacagacagcttgggaagcttttgctaaataattttgctagtttggttttttttgttaaacataagcagttccaaagttgtctttttacagacatttgatagaagacataaaattaatatttttatttatatttactaaaatggaaagatgaagtacaaaactagagcagtgaaaattcctctgcttgaaataaaatgcatctttcaaatttgaaaaagtttcatcccacgtagacaaaaagaatatctcatgagttacgatgcaattcagatgagacttgagaggacaaaacaatgttatgattttttcttaacacggtcagattcatgaaataatacgaaacacagaaactgattaacagatgtaaattcagactggaccatacaatagttggacagaacgggctttataaatcaatccaacccaattttatatgagtttgtggttagatgagcattaacttattttaccgtcaatttttttataatgattaaaatttatatacgaattatatagaataattttatattatcaatcgatcataaattatattaagaataacttatgaagtaattattgaaagagtcaccaagataattatgcataagctcttattgatatgagatgaaaaggttcattctagtacggccaatgcatgtgatattttctattttttaatacatattttagataattaatatttaacgacttaagctatttgtcatacaaattataaataattgttacttaaaataaatgtacatttgtttaaaataattaatagttgaattaatataacctcattcaaaatatatagttttagttcatgttgaagaataattaagttatattcctgtgttttacagcatatcttgggtctattttatgcaatatgtattagtttcttatcgttaattagctagctttatgtttttactattatttttcttctggaattttattaaaccacaaaaaaaaaaaaaaaacatcagcgtacgttgtgctgctaatcaagcaaagaatccgatccatattaactagttttaaagccttcaaaaacagacttttcttgtggttcatagcaccctttgtacctcaagtcctcaactatatataatattaatgccattcacatgtacatattgggtactgctaagaatcgtccaacgcacgtattggacacaaaagcttctcctttttccctttgtatatgggatttttcggtgaaatgaatgtgcttgctgctttacattttatgtagttttctgatagtttcttatacaagaaggacaatacacaaactaaaaaagtcaagcacctgaaatcttccgccactttgcatctgaatgttacacagcgtccactatcttaatttttacttcacacaatttttgtaacttgaaataccaaagaaaaatattttttatttacttaaaatttattaagaattataaaattatgagtaaaattcatcaaatatgatgtaaactcacacattgtattggtttctaacaaattttaatcaaggtgtgttagaaaggctatattactaggatttgtatataatataagtttttgttattattattatttataaaaaaaatacagtttactcatgacaaatttttgcatcgatcgtataccagcatttacctaacttaggatactcacatgaacaaggcagattgctaacaccagaaattgtgttttctgctactatatatggcacccctcaataaaaaaatcatatgtacattcatgtaggtaagtgatgaaagtgaaagatatgaagacaaagaaacaagattctctatcatcagcgaatccgcagcataaaacgaggacaatagagcagcagatccagtgacagtaaatttgttcaaaatggcacagtttgttggcgggtgccttgggattagatggtatggcctgtgactgcacgtggagaagatgaattaacgagagtcagcgctggcaattcaaccagatgggttgattttgtggtgttaatttgaacgtaaaaattctagttattagtttcttaaaacctcaccccaatgcaaacacgacaattcatgtctaaaatgtgaaattaaacattctcatgagtctttatatatatagagctcatgatcaataatgcagccacaattaaacaatgtaagcctgaaattaaaaaaataagcaattagaggatgtttgcttttccatttgtttaatttgttgccacgccgtgttctaataaagatccaatttgtaagaaagaagatgtgttggccaatctctgtttggtgcaccaccaattaattgtcaaacatgcacttagcaggtgaaagatttgttgttataaaagtatactctgaatgagatatataagtgacaagattatggtagaaaatagtcatagcagaattttttttggtcaagttattttatttccattcagtattgtgaacttattataaacttgatgttatgtagataataattaatatatatatatatatatatatatattgtaattatgttttatttaattttgcgaatatgttgatgtaacatgtataaatttactattaatatttttttcaaaatgatcaagtcaatttaattaaataaatacacttaggaattattcaaataaaaactattaaatttataaataaatttaatatttttttcttgttacaatatcattatatatttatgtaaggaaatggaattaaaatataaatgtatagtttataaaagtgtcgtgataaaaactttattcgtaaaatgtgtctatgaatagtatgaataacaacacttttataaaaaaataaaaaaaaaaataaaaaaaaaacttgaagttaattacttgtccggctcagtgaaaaagttctgagcgttttggcgcgtgtaagatgcatggtggctgtgagtaaattagccataaacttttacatgagaaaaacaacaaaggaacacgaaaccaaaaataaaaattggaacatgaaaaagccttcccttgtttgccttttgtgataagctcgtgtcttaaggtcacttcatgggtcgattaattagctgtgttacttttggctaaatagaagatgattaagagcggcccaaagatgaaaagcaatagaatcattgttagataaggcacgtgaaagaatgaaaatcaagtttttgtgttatataatttataaataatcaagtatttaaacaggtatttagagttcatttttcaaatttatatgtatatagaaaaaaaattgtaatttgtttagtaagtttcactataagggattaattattggagatataagatttaatgaatcataaatgattaaggaaagaaaaaaagaaaagaaagaaaagatgttcgatatcatcggttaataaaattaataattaatgtttattaataaaaaaagagattaatcattaattttttaagcttaaaaataacatagatcacccaaaaaagtgaaagaagagaaagcaaaagttataaatgcaatgcctcttcatgtcctctttgggcaccttcttctctctttgtttgccccttgggggccacgagtttaatttcctcttcagtcttcacatcacacacttctctcaaggttcattcaattcattcctctctctcacacatcttgatcttgtgaattgtaagcgtgtgtgtgaaagtaccctcctttttcaaagcattctaaaactctctctctctctctctctctctctcttatacaaagtgtgttaatgatgcacttgaaaagcaatcacttctcacaccgtgttttccattgtctaactgtgcttaaagccagcttcttgttgtttggcctaaaaagtctttaattagtaatatttatgttgcccttctttgcaaagattattgcactgacgcacaaaagcagcatcttttcttcataaacaaacgcacattcattagtgctgtctatcgttttgtttgttactgtcctctctgggctctgcttctttctcactttctcatctcatcggttcttcccattacccatcagattatcacacatgcatctcattgcttttcacatgaaaatcaaaacatttctaatctagaaaaaaaaatagtatttttggtaatatttactacaaagtgcaaaccatataaaactatatggtatatgataactatatagtagtattttatattaatggcatgattcctcgtgcattttaatcccacagttttttgttttcttttgtaggctcggtacgaattaaatacattataatttgatgctctaaaaatatttatattttgacaaccatgcatggatgcaatcgatatttatttaactagtggatttcatcatgctacataatcaaatggagaagcgttttgttttccgtataatcggaaagggcaaaagtgcaccatattataatcgtaagtgtattacttgagtagcttagctttaatttccaccgaccgaaattcttttgggtacatacatgcatgatcattcacttaactcctacccaagcaaaattaaaaaggcaaaagcactaccaccaaaacaagttgttttcccctccatgcatatgctgataattgtctctatggggctctttatggtttctacaaacacgtaagtttcttctagaactatgcttttgttttcatagtacgatctaaattaatattttgcaaaaggcaatgagaattttaataccataataaggatataaattaattgagtattttattcgaactctactccttcaatactctttcaaattgtttatatcagtgaaaaataaaataaaaaacgtaagttctttgttggatgtcgggttttggtgttgaatccattgacccaacaattctattaatgtaacatacttttttattttaatttattattttgcatattttcataaataaaaaaatagagaaaaacacacacacacaccccaaacacaattatacaagcaagtatactagttttttcttatcctatctaggattcttaattttagaacaaatcaaaacgtgcacatcttcattgttacatatgattgtttgtgtttatagtgaaactgtatgaaagaaagaaaaaatcaaaatgcatatagtacaatgtaacaaataaaaaattatatcaaaatgtcatttgaaaatgataaaaaaaaaaattaaaaatattatgaaataatttttaatttccaatacctgtagacccaactcactattaattaggttggtttggtttgaatttgataaaaaatttacacaaatttaactcaacctaacctattttaaatgtgttgattagcaggccgatttgatgaaacctaaccctacacgtaatcattaggaacaaagtataattgtttcagaacttcggtcatagtgttagaaaaaatatatctaatataaatcatacaggtaactgaattgaaattgatatttaagaattaaattaagaatatcaatgaaaagttttatgtaaaaaaacgaaacataacttacaggaaaaaaattcaagatcaatatcaataattaaaggttcttcaaaaatataaaattaagcattaaatagcagtaaaactacatgtttgtaatgtatggatgtaaattattgtacggtgttcattaaaaaagaagatgaaaaaacttattgtaccttcactttacttttggcatgtgaggtcgactttgttgtgttgaacatactttttttatatttaatgatttccaaattataaactattttagtttttgttttcctaaaaatttaacattaattggctatgaatttttatttttatactatttaatataatagaaatattttatagtaattaaatttagttgtataacatataccagtattatatttttaatatgaaaagtaaatgttaacacaaacacaaatacttaaaataattaaaaaatagttattttcgaaaatattatataagcgttatataacggatatggatctaaatgtatcaaagagagagtacctttgtccataccttcattaaaggaattactctaaaagcataaattggtgataattattaaaaaaaagtgaacatacaaatgaagatagttatatatagtaatatgaaattgtagcataaaataataacaaattatttagattataaatgattttaatagtgggaaccaatcttagatcaccaattatcacgtatgataatattattagtttttataataattacttgaaaagttatatataatatatttttaattaattaagagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnataaatttattataccatttatgtttatatttttatttattttataattataaaattattttataacatatttatttataaaaacattttaattaaagataaatttttttaactatttgactgaaggtacgtatgtataattattaagtttaatagtacatatatttaaagagttatactactattagttattattgacttataaaaagagatattgaatattttaagttatcctttattatatatatttttatcatttatttaatcttttctcccaaaaagtaaaataagattaaagtaaaaaatcaatctaattcaaatggttttaaattgatcagatttaaaactgaatgatttatatatgaaaattaaagattaaatcaaataattttattttccaaaaccgatctaattctatttgtaaaatctaatagtatttcttataccacgcggtgtattttttttttaaataaaataaaataaaatacgtggaactgtatagaattttccttgggcaactcagattcctttccaacagggtagtagcacagcaaaccgagtaagtatatcattgttagacccgaaacgcaaaccaaaggctgccaaaaaaataaattatagggcatgatttaatgaccaactgctatatctaaaaataggtacacactgtcatgtagctaaagcttaagtggaatgtaatctacactaataaattcattcagtttgttaatttcgcttcttcattttttattcttgacctatttggaaggacaaagaagatttcgttccacagaatataaatagtgtaggagaagaaaaaacagaatatgatcactataatatacaaaaagtgttttaaagaataggttcaatattaagtgtttctcacattatccgactctattttgatagagagtttctcacattatcccaaggccaagtattaaaagtattaagtgcatgtttgaaaataactaaccaacacggattctataatctctcttcaaggctcatctttcaaatatgaggaagtaggtcttggtagcttcggagttacgagtgtgtgtcaaagggtcgctcatgcagaaccaaacacgttgcaagtcagaacaaattacaatgttgagcgctagaggagtttttaagctaatgcaaaccacaagtatttaagagttccctatgaactctcacattctctatgttctatgtaagtttgattttttttaatactactatcatttttttcctgcttaattcaaatgggaaaagggttctaaatcaaacatttgatctaattctgaatatgtggatttaaactatatataatttcgtgttagatttgacgcattgcgagataaagtgtatgcttgctttcaattatttgacgcgacgtcaaactaaaggcgacaaatacttacttataagtaactgaagtgttggagatcgagaatttcctgtccatattaaataacccattccaaacatactgaaagaagaggatttttcctaagtcatttttaaatgttagaaatctaataaatgttgctatagttgctataaaaaattttgtttttagtattagtttcaatttttatttcttccaaataatttgtgataaaatagtgcaattaattatatcaattcttgtgagaccgatattactgcatttgaaatgattattttttttatctttattttccaacaaaattaactttaagacgtaagttaagcaaaatcaagtttgtaattagtccaaactctataacatacaagattcaaccttgctacataacgtagatcacatcataaaaccgatcctatgtgaacacatttgtttggccaataaagtaaagaattcagtgtaactcttctaccatttatttcctttattttcattattactaggtatacttgtattaaggacggatccagctattgacggggacaagcaggagcctttcctgttagattgttaaacatgagtgtagagatttcgcgtcaagtagaaaagagacatgttaaacacatataagtaataaaaatctcagacccaatatttcatatgttagcaaagatcttctaatggactttttgacaataaaagggtaaaaaaaaatcagtaattatcatatgagatatgagagtagttttaaaattatttatcatttggaaataagtcgtgttatgtagaatgactttcaaaatgaattcataattctatttatttacgactttaatgtgcataatttttttttacttccaaagtcgtaattatatttatgagttttttactttcaaactgtaattttttttctttcaaaagtcgaaaagatacatatgagtttaaagttgtatatatatttacgattttaaagttatatttttttattttttttcaccccgcacgactttaaagtcgtgtacattaaatattgctaaatgcacctcttgtttttttgataagtttttcagtaaaaattaaaacttgctaattacatcctttttattaagtatattccaatcttttcttttaaattttaaattccaaatgataatatttttaaaatataccccaaataattagatgattgtgttaacaaaagtagaaataattatatttgtaaaaattcattaacaaaatcaatatatttaattaacaaaatcaaaataaatatatgttatttcatattttacaagttaaaattattcaacaataactctctaaaaatttaaattttaacattactacaaaaatttacaaaattaattaaanttaaattttaacattactacaaaaatttacaaaattaattaaaatattaaatataattcaaagtaattataacataaattactaaaatacttaataaaataatttaaaatatttacaaaatattaaatcgtattacaaaaaataaaattacttgcatttttaaataataaaatcaaactacttttatctatttttaaaattaattaaaaaaactcaaaaccaatcaaaaaacttcacaatgaaacaaatgaaaataataaataaaagtgattataaaatatttaatatatatccatatattttaatataatatatatacgtatatatatatatacttaacgaaaaaaataatatatatatataaagctataaaaaagaaaaaagaaataattaaactaatacgactttaaagtcgtatatatatttacaacttttgaacgtaagaaaaaaataaaaaataaaaaatttaagtttgaaagtcgtaaatatgtttacgactttaaattataaatatatttacgacgtttgaacgtaaaaaaattatgcacattgaagtcgtaaataaagttacaacttcactttaaaaaaatgaaaaaatataaaggttatgataggctgtaggacttttgatttacaaattgtaacatgtgacacgacttatctcaaaatggtaaataattttaaagctactcacatatggtaattattgatttttttacctctttacagtcaaaaagcctcttctgatggtctgtgtgtaatttataaatttttattaaaaatattaattattaattagttaatttttattattaagaaggatttaaatctatgatatatttttttatatacttttaaccattaaatcaatcctacctatatttccataactttacctataatgtgttacttcatacaattcttaatactgttttttttacttgaaccaaacatactaatatgttgattaaaaaatgacaatgttaataattgtgttttcaaggcttttattaataaataaataatttagttaagggttgccaaccaatgttactagagtgtggttaagaagttaaaagaaaaaagattttcttaaaaatcatatgaaaacatatttaacaattgtaagagaatctatttttatgcgtctgaataacaaaaatcttttacttccttaaaatgtatttatagagtaatttaaaatattttaattagaatgtgtttttaaccttacatcatgtaagttgctccatcaaatgcttacgaagatatattattgtttgtttgactggatggagtctatcgagtcttacaagacttggactaagtcaggtgcagagcaggttataatattagaattatgaaatacaaaaaagttttttgtttgtatcaaaatattgtttaaatttatttcaactaaattccaaaatttaattactttctatcattttgatcattaagaatatgttaatatttaagtcacatgcatgtacgtaattttggactaaactgagtacaaatttatagtttaaagatttttcgaagttttgttaattctaaaaactaaagttgcaacaaatcacaattaagcactacattatccatttacttgtataattaacaaaatagtaacgattgaattatttttcatttctttgtattttaatgaagggtatgtcataaaaatagttttaaatgtagggtataatcattatagtaaattgcagtaaaaagagtcttatgataaattttttacttaaacatgtttttcatatttataagttagtattttttatttttgtaaaaaaaattatcattgtaaatttgtgctttgttaattttagtctctttaagatttaatttttttcatttatagtttttgcgtttacatagataaaaaattgaaagagacaaatttatcaaaattaaaaatatcaaaatacctcatagagaccaaaattaaaaagctcaaatttacaaggaataaaaataaataatttttttacaagtatcaaaattaaaaaaaaaaacttatagaaatcaaaaacatatttaaatctttttttattataaataacagtgtatttataagaccaataaaatttagtataattaataaataattgaattttttaagcatgttaagagtaattagattttcagattgtaaatatgaaaaaaattgattaagagaggaaaaactcacttccaatttaaatgtgttttgggaattaattttatgacttctatcagtcaaaatacattgtattttgcttttcaagaaaggaaaaaaaaagtgtgttgataagaatcgatacaggaagagtttaaacgaggtgggttacaacttacaagttcgtagttactacgaggacaatggaaaatttgcaatggttgattgatttaaaaggaagccatgagagtggagagaagagggtaacacaagtgggggcaacttgtataaggaagacagctagcgaagtgaagcatggtggtgacttctgagtcacatcaaacgtaaagtccaaatatgtcaacaaaagtcgcatcaccgtccaatccttatccaccgttgacccctaaacagtgtgccagaaattatgaatgaatgaaagttgcaaatgtattagaaatgtagaataaagcaccaatctactcaaatccaggaaccaatatctctcatcctccaccttctcgccatttctgatcaccattccatggattattgaactattattatgcttgtttgtatttacattgtatttacattgtttttaaccatttaatataaacttcattatcatttctctttcattgatcatatatgtactagtgctagtatacaacatttaaaatgcacttttttgcagggcatgattggcatcaaatactccttacttcgtgagtctaattgacctaaaatcctggaaggacaaaatgtggtgactggtgggtcaaaattacgaacacaactcattatttgataaaaaataacatgtgactcatatcataaacataacaactcagtatcttttggaaatatatataatttacattttttcaaaaaaaaaacaagtgtaagtgacggtactttttttttcagtacatatcataaatatatactccttcttgtcttaattataagtaaaaaatatatatatttcatatttattaaagaaattaattaacttcattaatttatgtgatttctaattaaaaaatatacactttttttaaaattattatttattgaaacttaatattcagcattaaaaatctttagctttaataaataaaaaatattttaaagataatatcattgaataaaatataagtaattataatttgtttatataagaaatttttgttactgagagatcaaaagtaacatatttcaataaactatagtactttgttttctttaacattttcaaatcaactaactattgtggtggttttgacaactcgcaatataaattaattacatgtacttagatcctttactgtctaagaaagcctaacaagcataaacataagcatttaaatgtctttctatttctttatatagtcgttatttctttttatgccgaagctaattctctccttgaattctaaaattttaataatcattatttttatagctatgtaggtatattggttattattccaaaaaaaaaaaaatgcagaatctgggtttttgtcctaacattctaaaatgaattttgttgggagattttgctgtctgaggggctcagagcaacctcacagtgtgggctcagtgttcaaacataaattccttcctttctttaatttcctttacccatgcaagacagcctgccaaaatgcccatcattgatgagccaatggcaggaatatacgaccccttcaatactacaataatgtaatcgccaattattttgtgtgtatatctatcttcgtatagttgttcatttatgaatatcattaaaaatgatgaattttattcagcaatattttatactttttataattaaaagaaaaacatagaacaaagggagagagaatttaaaagtaaattacctaatgtgataaaaaaaaattatgtaaaaaccttataaaatatgcctaaaataataaattattattcttataaatttatgattaggactgtttgaaacatactcctaattttatatgcagtatttcactgaccattttcttctttgaaaaaaataatctaaaaatggattttgaaatactgcaatgaaaagtatccaaatattattaatttattattcaaattcaaatttcgatgacttttattagaaaatcacaagttttgtagttttccaacccgaatttttaatggcgcttcaaaacaatatcataacattaacggctaaacctaatattattgagaaagcatatataatttcattaatttcttatatgttcttctgattttgaagagaatttatggtaattaaatctgtgaatttgaacatataagtaggacaatgcttttgccagtttgtgtatgtttcgatccccgaaaacatgcggtctagatgatttagcattagctaccatgcattttcgggaagatcatatgcaaagcttattcaattagttttaaaatatttttgcttaaagatcaacatgtggcacagaatttataggaatccatgctaaggaaacttcttcctcttctgtcactgcttaattatcagattggcaaacaaggcctcatatatatatatctagctagctatggttctttcttcctcctgcaaactcaactgtgtacaaattaaattttgactgccaggttcgctatacaaaagcctccctagtttgactaaggctacacattgtacattcatgtagctttcctagcttgccaactaatcaagttggtacagaaaaaccctaaaaagtacatggagttgtcattttctctcccccaaagtcattaatttctttattaactttattaaatatatatagtaaaataaatcctgacttattctcactatatcaacatattttataaagaataaatttaattaattgtctttgaagttttgtaaaattacataaataatactctctacttttttttaacctttacaataatcttgtgttacacaagctactctggtgtaatattttataaacaattaagatgaattagtgtaatatataaatgagcatgatcagtgtatatttttcaaaatttaagaaggattagtgtaggagtaaaaaaaaggaaatatttgtgtaggttcataaaactttaggataattaatgtaatttattctttcgtacactacaaggctgtatttttttgttgacaaacactacactaacatctaacatctattgtgaaaagttttgcaacgatttttaaaacataatcatcattatttcacaattactattatcattattaccatttcatcaccactattgttacctccattattgttgtcactcccacttcattacctttatcaccaacattatttcatcttagaacaagataagataaaatagttcactcattttatttatttttaaattataacatctttttaaaatttaaaaataaagaataagtcaaaactcaaaactaaaactgattttataattgcaatataaatatcgacctattgattttttttatattaatctaagtttgtacaatattaactaaatctggaattaaacggctcacaaagaaaaaacaatggaaagataactaataaagaaagcaagagacaaatgggcctcggcccgtggactcattagaaaattatggcccggtttatttcgcaagcctgatctaagctgggatcactgtcttttcacatcatttagcaatagtatctcaataacgaataacttttttaaaaaaaaaaaaaaaaatctccagaaacaatattttttttcgtagagaatctccagaaacaaatgaataatcatagtgatttaaaaaataaataaaacaagtagtggtaatttgtttcttgctttggcattgattatgtgttgtctaatttctacactcacattcaattctcaaaatgtcatatattttgaatttaatttcattctaacagttttagattttgaactaataaaaactaatattctgtcaaaaaaattaataaaaactactactcaagatagaatttaaaaattatttattataaaaaaataaaaaatcaacaaattcttggcacacacaattagataacgatgatttaaattcttggcacacacaattaataaaaactactactcaagatagttttatatttttgtaattttgagtttttcctcaaactaaaagtattgatggttaagaaattaacacatatattgatcatgacatagattaaaaaatcatctcacatcactaaatttagatcatatgaagttaatttttatcaatcaacattttctgaatttgataaaaaaaactaaaattataaattttataaaactggacgattaaatattttattttaaaataaagaaataaaaattatgaaatttaaaaaataaaaggattagatatttatattttaaaatgatgaaatcaatattacatatatttaaaaatagaagtaacaaaattacatataattctatattcttaaatattagatggtatttattagaaatacatttttttaatcacacttagagaattggattggcttgcctgaaacaaactcattgcctttttattagaatcacaattaaataactattatgtaatgagaacactggcaaatgcctctaatgcattgatcaaggaattaaaagtgcagaacttttacaaataaatgttaattacatattttcattgtgattttcaatgtaaatctacattcatttttaaacctaattcattatttattgttttttaatttagttgttttaagacactcatgaaaaagtcttattttatctactcctttttgtctactattatatttttaataaaatttatattactatctactcatgaaaaatttatattttatctactcctttttatcaaaaatttaataatgtgtttatttatattaaaattaatttcaatttattattactattatatttttatatttatagaaagtaaaatattcaaaaagtagatagaaataaaaatagaaaaaccatatcaaattaaaaactactaaataaataaataaattttaagaagtagacagatagcaaaaaggagattggagtatagtgatatttctattcacactttgcggttaacatcggcatttcattaaagtgcgcgtgcctctaatttcagggttattttgtggcccgccctctaacctaaacctagggtccaataggaggtatgttcaaagatcgcgtttcaaaagtatgatagttgatgctttttcagtttacaatatgaaatcccaatcaatctctcacatgtatttcagtgtaaattaatcgacaaaacctaaaaaaacgcttttcgcctagagaattcaaggtctgttatagtggcgcaaatgaaaagctatgtttagttaagaaagaaaaacttaattcacatacaaacaaatcaagtcacttataatttattaagagtgtttaaattgtattatagtccgaatttctttttaaattaataataaataaatatttttattattttaaatatcctataacagtaacacttctaattttttctatttttctttttatcaaatcaagattttatcatatctatatgaggagtggtaataagacactctttcaaacactcctccataacatttcttcttagtagttaaaaatgtattaaaaattataaaatcaagaaagaaaatcaataaatagatttggatccattgaattttgtaataaatttcaatcaacaataaagatatttaaaagagtatgttaaaaattataaccctaacatttatttatctatatttattactctctttctaattctggatgttacataaacgtttggagtatccattaaattttattttctttcatgtccctttcttttaaataaaaatgttatagtatataaaataaataaaaaaagtgtgtaaaaataagaatagtttagtctttaattattaatcatcttatctttcaactttttttttttttccaaattgaaaggattgcatttagatatgagtgacacaaatttatttttctttcacttttaaagtgcaccaaactatataagtaaagataaaatttctatttccatttatctaatacatccattttctaccatttcaaacatgatgaatttgaccatgcaaaaagtaaaacattttttttatggtatgaaaaaaatttaatcattagatatatttttgcttatttgacagatgtgcaacggctgcaaaggattgagggaggtgtgatggtggtgcaggtttgatagaggtgggttaggattgagaaaagcgacgcaaatttgcattagagagggagggttatgtctgaaaagaagaaaaaaaactaaaaatctaaactaaaaatttaaaactgaaaatttacttttctacgtaaaagttgtttaactttttacatggtagaattcatctccaaacactatgaagcactgatactctggaaaaaaaatttcaaatgttcaatactaatatcttagaaatactccattttacgtatcggtttagtcaaatattttaaaaggtatttttgtaaataaaaaaaaagtgtcataaatagaatgaaattttttctttctctatatccacatactagttgaggtatttattaattttatatggataatttattatttatgtttatgattttccttttattatattttattaatatgaaatatactttatataaaaaatattatttaatactaagacgtatcggaaacgtatcaaaatattaaaattcttgaaaaatgtatcgaaattttgtatcgaaaacatatcaaaaatgctatatcggcatcgatgatacatagtccaaacatatcattaatctcctttcgtatatgagagtaaaaataaataaatttagaagacagattttaggttgtttaatatagaataaaatgaacaaaatatttttatttatttaatattatagaaagttaaagaaaataaaaaaaaatgtacataaaataacttaaatacaccaaataaaaataaattgtgatgtttttcaataaaaatgaaatgaaattcattatagatatactttccttcagtccatgtcatcggtaaaggaatcaataattttatttaataactttaatatttttgttgttttaaagattttcgtttatttaaagttatctggtatttttaaagtataggttacttttagtttgagttgtaaattttattttttaataaaataagagaataacttaaaataatattttaaattgaattgtaataattttatttatctttcttagatgtaaaaaatatgataataataataatagattgaaagatgtactatttgtttgatagtactggtttttttaaatttcaataagaaaaggaaaaatgagaggagagagagagagagaaggaagtcggaaggagacgtaaaggaaaatggatacttgggtggctttactgagggcgagaaggcagagaggaaaaaagaaagtaaagggagggagaaagtggtgacattgcagagacttgtaataaatttgaataatttaaaaaaaatgttgctaaaatatgtattggtaatttgttaaagtttctataaaataagttaaaaaaaaataagaatttggagagagagtaagatattagtagtaatagatggataatgatggagagtgttattgggtgaagagtaatgagttagttatggtgatggtagtggaaggcagctaaggtagagaacatcaggaggtgcctcgagcccttcaatacatcaatcttcacgcgctttcttttttatcattttatcaagtgggtcccactactcacgccatagagacacccgggcggcgcctctctcttacatttccacttgtctactcacctagctacatccatcaattattttgtcattattatataagacaaacttcaacatctccacacgtgtctctttcttcttaatttctccactccaattcaattactaacatattatttctgcatttcttcatctacctcattacattacattctccttaaattccattaataaatacactatcatatttattataacatattttatattaaactttgtattacaaattatctaatatttaaaccttttagcaaaattttatttaatatattaaaccattcttgttgaatatactatacgaatgtaattaagcccaccaatgctttgacccttcttttgtggctgcaaccttttttctttgatgcaatatacaaacatggatgctaaattcttcagactgctttgcacgacgatgggtacctacggctacaatcataataccatacctttttacttcatcaacacgatgatttgtgttattatctattacatccttgcatatctataagatagctcgatcaggacctttgtgaatgtatttaaacaaatactttactgaattggacttattgcaatactcgacgttgacatgccctccatttcgtataagaagataaggattgtaggggaataacactacgattatctaactttacccccattttcttaacccataaaccagaatcatgacgtttatacttgggataaccttggtcaatgtatgcgcttgtatttgttattttaaattcttttaaaaaaaaacattattattttatcaattatatatacttatatttacttgatttttgtagtcattgtgtatacttattatgaaattaaaaggatatagaaatgaagaatgataaataaaaaaaaaacaatttagtattcattagataatgaaaaccttaatagtattaaatataaaaaaaaaagataaaaatcttaatataaaatgacaatattaattgcatttttagcttttacattccattttaatattatttaaagtgaaaaaaatagaaagtaattaaaaagagagacaggtatatgtacccgtccggtccatttaagatccaacttacgaaacccatattttatatgggtcgaacaaatctgatctactaaataaatgatcttatttttatgatttgtatccaatctataaaaatatgctaataaatggattaatcaactagtcgtaataaaaatttgaaaatgaaaaatctattaaaaataaaggtaatttatattttttttaatctcatattatataaactccaacattatttcccaaaaaaactagtgagtaaaagtaaataaataaaagaagaaaaaagtataaacttagaagttcacgggctagtaggtgaacccgtgcgttaaacctgtaaaagttcaaggtttaaacgggtcagacctaaaatcgtctatgactatatgactatgcggactttttaaaaaatggtacgttatccacctggtctctagacttaatgcactagtccacatacctttgctcgtatactcatccttattgaaaaataaaaataaacatttattctttttttttttttggtctatttaaaggggtttgtaatttaattcatgtaaaattatatagtttttttgtcaatgtaaagtcctaactcttatattttaaaacccatcgttttgaattataggaattaaagactttaaaaatatagattatctttttatctattgtaattggctgaagttgttataagttacaacaattaatcatataggggaaaaaattaaccaattttattcattagataatggaaacattaatagtattaaatacaaaaaaagtagattgttgttgtctctccatctttttttttttggggtcaagattgttgtctctcctattttgatggtgagaattgagaagacaaactatagtggattgaacactgattcatgatccatggattaaaatgcaaggcccacacctgaatgtaacaaacaaatctccaatggactattactctagtcgtggctggctaagaccgggtggacgtaagttgtagcacttacaaaaatactaattttcaatttaccagagaaattatcacaataatagtattttatgatgaagatgaagatacttgaatgtgaagctagttttcatattaataggtgtaggttataggtcccttaaagggcaaaggcgattactaatcaatacaaacgactaccaattagtcttggatcaataattaggattagttgtcactttctaatatacattatgtcacataaaacaagatgatgttgtgaggatgtactttgacacttctaatgggtactaattgggtccaaactacctaaaaaatcttagctctggatcaagttgcctcaaaaaccttaagtgggtcaatgtcttttgatcatgatagaaacacccaactgattgcaatattgatgatcgtggcaacaatataatcttaatcagcggtgccaattacttgccatgtgagacatgtatgcatcaaagtaataacttgtgattttacaaaatcttacccatgaagattaggtttctttggctccattctaacacaggtccatgacaaattaattcaccatatattgattaattaactcaagagttgaatactcagataaagtcatttccaatgcccttgtttataagtaaggatcgcttcaagtaaagtaatgttacataccaaaatttgttattggagcaaatgtaatatatttaataaaattaagtgaaagttcataaattatacgttatgagccgaaaacttataagttaattgttttaattaaaaatatttgataaaaataaatgataattgtcaaatgacgtaaaaagatatatttaatattttttaatttgtttctaataacttatattcttaaaaaatagaataataattttataattttgtattataagaaaattgtaaagatttggtgattttactcattgtttaaactcaattttttttcaaaaaaaattaaatgaaataaactttattagaattatattgtttaaaatcacttttttacatttaaatactttattaatgatactatttttaaataaaaaataaaaagtgtttttttataattttcttaaacatttatttatacaagaataatttggatatgtacgtctctcattacataaacatgatataaatcagatattctattttaannnnnnnnnnnnnnnnnnnnnnnnnnnnnnnnnnnnnnnnnnnnnnnntattttgtttaaattgggtcatataattaaaaaaataattcaacaaataattgtaaaatttacatgattcaaataatttataacaataaagaatggtgtaataataataattgacaatttaattgttatgtgcatgtaagaatgataatttagataagagaaattttcaaacactaaaaaaaagataagagaattttaaaattgaataaaaggataaaataaaatttcaaataaattagtaaaaataaagttgagaacaaaaaaaattatttttttaagctagtttatttttcataaacttcttcaagtaactcatcaaaataaaataattgaggtgacttatgaaaaataagttattaaaataagcttaatttaatcaaagtaaaatataagctagtaaaaggagataaacaaattataagatctacaaaattaagttaaatatttgagtgaatttttgtgaagaatgcttaaatatatatcacattataaaatctataaaatagagataaacaagccatttaacaatgatcctctatcattagtgtattcctaactaatatgaaacatcttaccacactcttcatgcctaaaattgatgccatattgtgctgattgctgaatcaattgttctaaaatccttaattcgtttaatgaatgcacaaataattttaacaatcccccacataagaatccattaagtttaaaatatagataatgcataaataataacatggaaaagaaattgtccttttcctctaaaactgatcgaaatcaattcgccaacaagaatacaaaggaacgtggatttgtacccgaacaataaagaacttgcaaatttgcatgtagatgatgctacattaaaatcacctacgatggtctataaagtgtagtagtttgtagagtggtccctcacataaatatcaatagcagagaaaaagtctgggcttgtttgcttggttcagtagactcagtacagacccctacgcacacctactctctcttttatgtaatctcactgtcattgctcaaatcttcagaaccctacccctcatcttttcccagccattcacatcaccattttttctatactaattttattctttaaataccagataatcagataattcacttgacaccatctataaagtgtataatataacacgacccatccccacctttatatcttcttactgtatactcaattttcaaactttcttaatatttcacaaaataaacacttaatgaaataacacacattcaatttttcttcatgggcataaacacattcaaatatttttctatttattaagttggaaggtttgaaaaaatacattgtaaaaatattattaaagatttcatattaactagtgatatgaataaaaataatattcataataaatgaaaaataacctttattttattctgtattatttttgcagttgaattagattcaaatctataattgaatatgatattagagtatattttaaaaatgttgttaggtttatttgttgttaaatatatcatatcggatcagttagactcactgcatgttcaacttgtaaattttatgttcataatattcagccatcaacatgagaaaaaagaacattcacttataaagtagtttttggagttaaattaatcctaaactgaaatttttatattttttttatctttgttacttcatatcatatgagcatttaaaacttatttctctaaaactaaaagagacaaaaaaaataagttgtctcattttggttgcagaaaaaatatttatattttttttcagtaacggttgattgctcgaactcatatctttatattctcccaaaaatgttgcagacattttcgttgttgcactacttttttgggggaaaatacactgaactgggctttgactgaattggattacttcgattaacaggttacatattgggccattcaaccacttattatagcccaaattgacacaacaaatgttcttaaaaaagaaaagaatttcaaacaatgcatcgatgagcattgacttttcttttaaacaaagagcattgacctttccgactcataatttttttagttcattttatccctcttctcaacttcttaagaatatttcaaagtttatatacaaaaccatatcctttatacacaataaacatgtacgaattatgcaattaattactaggatatatagtacaaatttaactattgacggaataatctactcacaagagaactattagaaatttcaatatacaaattcttttgctatgaggaataaataatcgattttttaatataaaaagtaaaatattttgtaaattatcaaaagtcaaaatatagcacggtattatttatatcatggtccagttttgtttttcctttactttaagatgctcacgaattgataatgcaacccatattatctgtgtatgagcattggctatatatgttttatatttgaataatgacatacgcaaaacttttattttatttcacatgcttaccaaattctaacattgcatcattcattttttttctctcttttaattttatttttactatctaaattctcaacctcgatctaatgtctacatatcaattatactgaagacggatcaacttaattgtcaaaagagtatcgatcttttttagaattacttttcatttttattatttattttcttaaaattcaatgataattataaataattaatcctaatcattaaatttataaaaaaaatcaataattaagataaaaaagtaaaatacaaggagcaatcaatccatatacagaatacacaacagacaccatgtcaataataaggttctaccctaagcacttgcagcccttcaaacaacatagacaagtgttctattcaagaaaagcatatgccctagctatagccacatcatacatccactatgacattacaaccccttcaaacattccatgggatatattgaccactcataaataaacaacaaaagagaattccttcaccctgtttgatagtcatacccaagatctaaatttagttaattccaaggtacatgttcagtattaatgataattattgttgaaaataatgttcattatatggggtaaaggcatggaagactcgaaggaccacactaggatgcactgagttatttggttcagtacctgctgggtcaagcttatttaagcgtgtaacaatggctaaattaaatggcattaaaacaaaaatcttctggttaatataatgcatataatttcctttcagcctttcctttctttggagtttggacccgctatactgaggtgtagacacgtactgaattaagcctctaattaactccttcgctgtgtgtctttgctgattgattaatttttttattaataaatattaatttgttaattttgttaaaaatatcagttacaatctctcattcctttcttcttccttcatattttcccaattaatgaatcaaccttatatctccctcccttgttgttcaatgcatatataacttcctacactttttgcttccacgcaaggttagttaccagtactcgacacattatcttttgatctttttataggttaacgtttggatatctaaaatatgtagctacataatattacgggatacaagtagaatgcaataaaattaccaaagacggaatgaaataaaaatttattagtttataaactatcccgttatacattgaatggatgacacaatatccatttttattagtttatttatatgttatcctatttaaaagaatgttgtcactcctatttcacattcttgcaataaagaaaaagatcgataaaaagaaaaagagagaattgtagggtgataaaggaaaatgcgcagaaaaaaatgttatgaaaatgtgatataaagtatttgtatataataaattatatatatatatatataataacaactacagtgatctatttaatttccatctatttcatttattaatttctaacataacataggttttataggacaaagggaaacctaggtatgtcttgggctaggagaacgtcctaggctcttgacacactatatatatgctttccagatgctcaatttttgagagtctactgggtatatatatatatatatatatatatagggcttcctgatcagaagttaagtttcctcaagggttcaattctttgcaaaactgatgatgtcttttacaccaagttcctcatctcaagacaccttggtgtagctctctatctatgttttcatcaatatttatgtttagaaactgtaactgactgtctaatagaattctaaaatgattcatgaacacttctcgtctatttaatttgacatgcacttggtgagaaagagaaaagaaagaggaaagtatatacataataagtaatattatgtgataaaaaagagagagaaataaacagaaacaatgagtgttaatcagctgtttcatgtcaaagtgtccacatctatatatactatccttcaatagaatttgtaattaattttttgtctctatctcactccttatcaatgagcagtaaatttttttctgtagttatttacacacggaagccaaatatatgaatcacaaaacttagagaaaatgaccttataattgagagggagagatcaagagaaatgaagaaatagatgagtatgtaaataaaggtctgcgatctttattatttctagctgtgtaaatatcacgagtctaacttttttaaaccactctgcagcaaaatttcttcaacttgcaattgatataaatacaaatgaatatatagttagtagtcacaaagtcagtaagatatatataattaaacatgacttagaattggggaacaattgcaagtttataaatgcaagcttcactttgtacatcaactaagaaatgcattaaacaactcagaaaaagttgaaacaattaatttccataatatcattcacaaaattataaacaaccaggaaaaagaaaaagagtggctaattaatcctgaaaggccagaaagaaatataattaatgtatatatcagtgtacaaattgatgttttgtgtgtgtggagtacttctaattaatcaagaaaattgaactacatagtaaacatttccacgggcttttctttttctttccactctaaccctatgaatctgcatggcgaaaacctaatcttgtattccgaaatggtttcaagcttaggagaccacacctgatccttagacttcacaagctgttcatagtgcttttgcaactcaggagtactgcacagaaaactagaggggctaccaggggttgttccaacaccattattctctttgttgtgatctccaccacttatgagcctagtgatgaactcaggcatgaccttaatagcaacccttccatcagaacccttcaagtactgaaaagggcatgcaccaaacttgataggggacttgttagggcaagatccaagggcagaaatggaagccacagtgaggttgttgcatgcaaagagatcaatggggagaacaaagtaggtttggccaggcatgagtttatcatctatggagagaacaggaattggttgtccaatgaagaaagagtctgcatggcacaccatcatttcagggaactcaaacatgatctcaccagctatgtgtttccctttaagggatcttggtgttccttcccaaaatatgagcttcacggattttgatgatgatgatgaattggtgttgagttgaaagcatggagtcttcaatgcgtttcccatttgaataagagagaataatagagagagagaagtggtgcaagctagctgcttagacaagaatatgatgaagagattatatatatagatatatatatatatgtatatatatatatatatatataaggatatattataatgttgactttggataaaatagtgtggtcctaattttatttcattatgtttttggtacaattaattaaaaagtttgatggggtcggtggtctggtcagccatgccggctttgaaaatttcactttctatatcgtgatgtgtgtgggatcttttaggacacactcttgtgccaggctctatagcaaaaacaactcatacacgaacttcacaagcttaacccttgaccttgcgtgccttttactatttatattcaaacctagttggttaccctttttctcctcccattaatataatgcacaggactataggaggagtatttagggttttactcttttaggggtgaagattaattcattaatgtagatatttttgttctaataaagacctaaaagaaatattaaaaaaaaaaaagatgttaaaattcttactttgttattaactatgaatagtcggcactttatacggtccagcgtgggggacgaaagtacaattatacaattaaagactaataaatttcatatcttaaagtttaaaaggcgttggaaattaaaaaatttccctcaggcagaagacgtgtacgccgtttttgttaaaaaaaataatcctgtagagttagtaaattttgatcaaccatatattattttgatcttgaattaaaattataacacaaattaccgaattacaaaagattttacatatgcttgtatattataaagtgaaaataattcatatattaatattatgaataatttttataatttcatttaatcaaaaaccgtggtataataattctattaacttttataacaattacttaagtcatatttattaacttttcatggttgagacgactgtaaaaacttctacagtatcgatgcatagaacttaaataatattataaattagaatttttaatttatttatcctaaattataattataattatataaaatttttcatattttataaaatgaacagaatgattaaaatactacttcaaagaaagcagtttaattataaaaaaaatcaaacctagctaaattctctggtttatcttcactacttgaaactcaagtaacatttttttttgggtgctcaaactcaagtaacatataacatatacttattttgatatagaaatttaatcattatccaaagaataagttagatccaatcatctcatttttttggataaaattaaccaccgtattactctgtcatttgtgccaacgtcatcgaaaatatgacctaaccaatcatccgcgaaggcatctctaagtttgaatttgttgactctatctaatccgtgatttgagctttaaaattttgttgattttaaatctaataaacccaactaattcatttaatattcataatttaaggagtgactaatatatatttcaaaatcagtaggtgttcgtttggttctttcaaactaaaattaattggttcgcaagcaagttcccttcgtcataggctgatattaatcgaacccaagttgcggtttaagatcaaacttgtgactttcacgtgtcaatttgctgctttttttttttattatgtaaatgtatagtcaaattgcaggctataattatataatccgtttaccatttttatgccttcgatagatataatagaagcctatttattaatgtaattagtttaaaaatttgtgaaggaaaataatatttccattgtttatagatattcttacgaattaaaaagaagtttatctcaaagacttaaagaagttcgatttactaattttctttgataaattgttttagcctttattaaataacgtcgacccttttcgtaagtcacctttcggataataagtgaactcatcaaaaataaatttatagctattaataaatgacttgtttctgaaagaaaaggaaagaatataatatgaatgcgactataattttaaataattgtgtaatttgaactaataaacaactaaaatgggaaacaataacgagaattgttcaaaattcgcatgtgatacacatctgtgtaacctatcctcaaggagctaaagagctgacttttacattgtcaatagaacacctgaaaagcaatcgttatatacgtacataaatatatagttttaaacaagaaaagttcttacacgttcatatttcatgttctttcttcattgactaagttgtcacaatgggggaggaagctagaagctataaagatataaagatataaagataaaatgaatgctactagtatcaagttgataaagaaactaaaatgaatttcattatttatgctcatgagagaaaaaaaaaaattaatcatagaaaataaacaggccaagcaaaaagctaagttgattttatgtttttaaatggatcgatactcttaatttcttctttccctctcctacctgatcttccctaagtaaattgacggaaaatgataaaataaaaaatatgatatatatatatatatatacacacattttttgtgactataattaattatcataaaaaaactataattcgtaattatggaaaatgtttctaaaatataaaagagcaatatatacaaatttgtatttgtgtacgtactcctgtataagacttccaattttgtagaatacttggaaagctccaatactagactcgtctttcttttagattagggcatgtgactataaagtacaaacaatgcggcagttggaaacttaattattttattaagacagatgacgagtgaagactagtagtggtggccttttgcactacaaagaaataaagaaatgggaattttcatttttctaatctgatttggacacatgataaatttatccttttgggcattaatcattgttcttatatataattgaatattccaggaaagtccaaaaccgttttttaggacaaattgtatcttttgactccctaccaagttaatatagtttttcttttctttctctttttctttttgttttggaattgaagttgtaattctggaaaatatatagtgctccaactcgggaattttcaattttaatattataagactgcatgataaatgcggttactcgctaaaaatagcattttgtaatctttaatttattcttatcatcatcaattatatggaaagttaaatattaactatctgttaaatatttaaaaaggtgcgacataaaatattaatttttacaccaataccgtataaagtttatttctttcaataaaatccttttatacaaacaacctataccgatacactttaaaacattggcattcgtaatgaaaatctcgagaatgatcaataataaattctataaaaagcggaatcctatataaattcattttgagaccgataaaagatgtttaggaggatatttacttttctttcctttttgtgaaaaaattgatttgagacttgatgtctctttctttttttccttgtgttataatattatcaaacaaatactaattagcataccaattattacaagaagagtacaagtaacacatttttttagtggtgaaaattgaaaagtatataattagagtgagatacattatataagtaagagtgcatcaacaaaaaataagtaagaccttcataattttgtaatttctaacaaatttaaatcaatattagctagagagtgttagcatttctcttattaaaaatatgcattcactaattataaataagagataattaagtttttagtccatcaaagtttttatataacttttaatcctttattaattttttattagcaattttagtccttctaatttttttgtctatttttagttttttgtttatttttattgctcaaaattaatcattttttgttaatttttagttctttatttattttatatttgagactatttttgaacaataaaaataaataatgaattaaaaatggacaatttttttagaggaactaaaaatgatgacgaaaaattaatgaatcactaaaagtagtcaaaaatattttgaggaaaaaaattataatatgaaaaatttgagggactaaaaaatttaattaatcctataaataattatatattaaactatgtatataactagacacgaccccctgcttacatgtaggctatatgagtttaagttttttttttttctaaaaaaataaactaagtatataactttgaaatattatatgtaataataataacaataattttgttattattatatcattttttaatttaaataaatcggtatttgtgaaattaatttaaaaatatttttaataactttaagcttaactatttaactaaataaatagtttttttttctttccaaaatgccttaacctaagttatttagcaaataggtatgaattgacttgggtttgaggtaggttaggttgtaggtgtttaacaatcaaaacaataatcaggcacaatcaaaccttgcttaaaatgaaaatgtatacattgcatgtgcaaaaagtttagaatgatacacggatagactacttcaattcaaacataattagaatttgatcatgttaccaaaggttccaatacatgtctaaattaacatacaaatccaattatccaaatcaaacactatttcaagaaaaatagacgttccaaatagtataatacaagtctcaaacaacagtaacaattacttaaattacgtaataatatgtataccgtgttgagtcaagttaaacggatttagatcattgacctaacacacaatccaatttaattataattaggttaactaaaataaacttaaactaattcgattttccaactcaacttacagaaatattttttgataggctaattattagtaattagaatattatgttagttagaagatttgaatttataaccttttattgcttcaaccctacggaaatgttattacttattagctatagctagttaatcaaatttacgggtcaatacacccgctaatttgtgacacaatcaattggtagatcaacaattacaaaacttgcgcattactcaatctgtctagcttaaaccttgggctataaaggaataatatattctaagtagttttgaaaagagtacagatatcaactgtcaagtgactttcttctatatagatattgtattttattttaaataaaataaagcgtagaggttagtagcacaattcttgaaattgacttgtctctaaactatttaaagcatcttttgtttcttgattttctcaactagttgcgatgaaaaaaaattgctttgaaagaaaatgaaagtagttttagtgtaatttactgatattcttttgcttcaaaatataatagtcgttttattcataatcaccacgattgagaaaataatagacaaaagtctctaaattgcgattagaaatggaaaaataacgaaataattaaccatttaaaaattgaagaaagaggttgaagaaaaacaccacccccaagaaagtctctaaacattttatcaaccataatgtgaagatgatcaacgacatagattttagccttgaagtcttgaaaaaattattgattattttccattgcgcaatttcctcaactttggtggttgatttgtgatgccctcttccaaatagttaatttctctccttcggtgggtggaatcgactcaaattaatctgtgatataacgtcaaataaaagtatataaatacgatgataggcgtcagatttgtcatcaaaacaccagaaattaccaaacaaaagcaaacaaaaaatagttgagctgacatgagtggccacagtctcagctaatgtagctaccaacaaatcaaggctcaaaatatatatgtgtcttgaaagaattaacacttgggatagaatggagaattttaaacgatatttttttaaaattaatgttatgtattgttttcctttccaaaaactaaaatttgaaataattttgcgcctacttatatcagtcatcagagatatatttatttttaactaatcagctatcgtctttgtcattcctagtttaatatactttgttttttgttatgcatcgaatatcaagttgaaatgcgggatttaaaatttaccgtttgaaaggagtcggccgagataattaatcagcatttactcaaataaaaaaactaaaaaaacatgttattagattatatactgttctaacttcaagtgtgttagtattattttagtttgtttaaacttatttattgaaataaatttgcagttattttaataaaataagtaattttttatattttagtgtgattgtttaaattatttctgcttaaaaatatagtttttttatacttattttaagaagtaaatttatctgttttttattaaaaaaacacttatattaaaaattatttattttaaagttgtttcttttaaatttaaacaaatccaccttttattaggatcactacatcttaagtattgtttattttgatatttattaacccgtaaataacagtgttgttcttaaaaatatgtcgataaatttaaagagaaagtatttataaactattttttaccttgacttctaagttcaaaattgacttacattattatagaattattgcatttaaagtattattagctttaatacttgatagtctgtcattattctttccatatatagctcggtagattaagagatgattgtttataaattatctataaacctaagtaaaataagactttttagtatactaaaacatatacgtcaaagatatagtttactttctgattagaatacgtcaagatgaattttgataattaatttttgggtaaagtgactacatatatgtttatgatattgttcttgcattctttagtacaacaacaaggtacttcttatgctgtcagctttttgttgtcaaatgtagcagcagttgccatttttcaacattcttagttaacaactctttactaaatgccatataattcaaaattaaacaagtccttatccaagccacaataattgttggtacgtatatttatttatttttaattactaagaatggtaaaacttgccatcgcatactattttgcaaaacttcttattaggtggtttttaactttttatatgatgcatctgaatagataattgttcagtcaaagaaagggaaattaacgaacaaattaaagataatataatttataagcatacttagtatgatcacacatacttatccgtttccacagtatatatctatgtatattggttctcctccatcatcagcaattaatgacaatgaaactatattgaaattctcccctttgttcattgaaaagttgaaaaactcttaattttcagggtatgaacatcattaccatcgttgtcaatttcatcattagtctcaacctctcagccattataaacatcatgcagccgcagtttctctttctcctaataacatatttatgaagaaagaaaaaaaaaaatgcctgcttgtgggttgatactatatttaattaaacttttcacttgcttggtcaaatttgattttgtctgattgagcaatttgcaggagcattcttaattaggtccccattcaatgtttcccatgtctaatacaagtcaattagaaacaatttagcatgtcatctttagacaaagcaatgatatgatgtcgttagattaatagactaaaatccctgtggccaaattgataatgggggatgattgtcttaatcacatataaaccattttaccatggagttcaatggggtggcttgtgtttaagcattcgatttaatatatttttgggtttggttagcattatgctttgagttatcgtaatagtattgttatttttgtgagttaattagttatcttaatattgtttgatgtcaaatgaacttataactattttgataattaatagtaaatgttttttatttattttaaattaatatttttttatgcataggaattaagatggatagagagagagagagagtttataataactcatataatctgtttaaacaattgaattagactagttggtatagtataatatgtgaatataattaattgttgatatatataattgtttttagaatatatattgttcaacatcatttagtttataatataattatacttgtaatatttaatttatatatgtgatcaaactatggaatcgatcaacatattcttaatcattattatgtatcaccagagaatagagatgaccacataggattaggatctacaaaaatgatcttatcaaaatattatagcctcttaaatgtgaacccctacaacttatcaaaattataatccttattggctgtagttgttacgacacatatgttagttattttttcaagagttacattgaatttatacactataaacaatatactcgttattttaaattttaaaccagataaacatttttcagacacgtataccgtcacgtatatgtgttttaagcaatacaaaaatacattgacatttaaatatttaagacatatagcaatgcttatatcatccaagagtaagcaaattaagctgaaaggatgatatataccaccccatgtgttctggtcataatccatttgtcgttgcttctaatttgaaggcttttgaatacttcaattatcatgatatcatcccactcaacaaactacatgtccatatacattccggatcatgattcctacgtgcattaatctcaccattcaaacgggcataatgatgaaaatccgacattgatcattcctttcttaatatgattattaatagttaataataaaaattagaaagttgggtgtctgcgctagtttgttgtctgaaatggaatatgattttttattttgtttaaacttgaagggaaaggtgaattgatccattctttaaaaggaagatttagtcattacattgcatcattcctgcccttcaaattataatctggtctgctctaatggaaggcagataaagaaagcaaagccaaaacatagcatcatatattcacttttattacattttcttaaatcttttaaatgggttgagccaattctgctcgctgaactaagatgaaaaactaatttatctgactttatccaaatttctcacggactatatttttgttctgactgagctcgtaggctcattgaactgggccaaattaatatttttttatactaaatttgtatgaattttaaaagaaaaaaataatatcaagccaaataaatcctaatagttttcgaaatttaatttggtcagggctaaaacttcatcatgcactctacaaattttctaccaacactcactttcattacaggaaggatatttctgaatgtatttttacagtctagattacctttttccgtaatgaaatggggtattggcgaaaaaaatttagagtgtaaaatgaaactcatcctaaccagtgtggttcattgagccgaattgatccaattctttttagacctctacgggtccgctagttgttaagggccttgatcttaaatttaaacatcaaaaaaatcatttttcttgcatgaataagaaaaacataactacaaccaaaattttgatggttaaccttaaatttatagacgagttattttctttttatgattattaagcatcttacaaaataatatagaacttcaattaaatcatcatcattattatgattgtcataaatagagtaattagtgtgtctgctaacattagtatatttaagtagtttcacgatgcaatacattatgaattagattttaaattgcataatttttttatagacaaaatttgtcatatgataccttttagcataacagttacattgatgaaactttaatatttgaaaaaagttatgatagatataattttgcctactttgacacttaatgtaaatatacataatcatcaagataatactatataattcaataaaatagataaaacttattttataacatattaaagacgttattttacagtgttacacacactcacactactatatttaataactctttgcatgatcaatggctgaacaatctctacattttgtatcagatctttgatccttcatatatgtagagagaaagagagagagacgcacacatatagcatgtagacaattcttaataagggtagtagggactgataagaagcagagacataaatgattaaaacattgacaactgaaatttaaacaacttccatagtttatcacatagtacgtgtattttatcgtaatctcaaccattggttacaattgcacttttatcctctaaagtgcacagttttgtttcagaggaattaaatccaactatccaagacagcccgtggtagctcattagaactaagtagcatgctactgctggcatgtgtacatcatgcaaatgtgttaaggaaagtgctagctgatttgcttatgtaatgatgttgctgaagttcctcgtaccaagtgtggacttcaaacagatcacaatctcccgaaacatcaaatgtgtgaagagtatgtatatttaatatgacggaaaatcataccacaaaagttagttattatagttggagagagtccaaagccccataaaccttacattagaatcccataggactcaagttccacaccttgaaattggaccccaacattccaccacactccacaggccacagcccctgcgcccatgtgggtaggcaatgcactagctctggtcaaacactgtgatgccatcattgcaaccagcaccacttgtttgcagctgggagacataatataaggctctgatacaattgatgagaaccttagaagaaccacaacacaaaaactagttgtagttataaatcccacactaaaatgtcatacttccaatatggaactcaagtctcataccttgcaattggatcctaacttccgaagtcctaacagactgtttctaggatttgaatctatggccttcaagtcacaatgcagatgcaattaatgtgccaatagattacatcactcttaaccagtggatataccaacacttaaacaatacggaaagagttcaaaattgggaaagcaatttcatgtggatcgtcttcaaaaatcacaaaaaaatctacaatttgttgcctcaatttctaactgtcaaaaagtataccccaatgatggatatgattatatcagtctaaccaaccacagtcaattccacatcatttctgtgtatctgttaaataaactttaattggaattggaatgtgattgttgtattaaaactaacttgaaccagaccttaggtggtaaccagtgaccactctcatgctacttgagagcaagaaaaaaagaatgcttcaactcccatgctacgcttcataattgcaatgacttccaggcttccccttcaataaattatacttacaaaaacattagtctgaagttcatgaaagatggtggagtcccccacctagctcctgcaaaccatgcttagaagttagaaacatggacgggttgcatttccaagcatctaaaacatacaggattcttcggttcaaattgaaagttgcaagatagaatctcattgtttaattaaatacaaaaaaaatatatataattcaggggcgggacaaactttctcggagccctatttaatatttttcttttttaaaaaacggggtcctcaattgacaatttaaaaataaatgactcatttaaataagaaaaatactttgctcagtaaaaattgttgttggtgggaattgaaccttggactccttggttattaaaaatagacattaccatctcctctaattttcaatattgaacatatattgcaataattaatatttgagaccccttattttttggggccctgtgcgattggacaccttgcacatgcccagaaccggccctgtctgtattacatatataagcatgaaacaagcaacaccaaggcattcaaaattgcacagttataaaaaacgagaaaggagtgttttcttttttctttgttactaaccagggcagggaggctcaacttttatgtttgggctcagaagacatcaaccagggttgtgcttcctgtgatatacagaaccagaaccagtgtggcataggcatagtctacaactagacctaataacacataacaaatatacatctgaataagtaaaattatcataagaatacaaaatcaatgcttacaacagaatgaggcaaatttagatgtcaccaaacgaaagaatatccaaccttttatatcaggtatttgtaacaagagctgcagcggtaaaagcatcagaatttgtcgtctggcacaaatcccctttgcagcatttcatcatggaaacggaatgcttctttcaagttgtctagagatacatgcccatttatcaatgatgtgtatgttgatttatcaggattgatgccacagtcaatcatcttgcataataccatctcagcctcccgcattctgccttgcctacaatatccaccgagaattgcattataagtgatgacatctggcagtagccctttttcttccatgttattaaccaagacaaaagccctgtcgaaattctcttcctttacaaaaccatttataagagtattatacgtaatgcaatcaggagaaactccttccaaaatcatcttttccaagaagtcatttgcctttaacacattgccagcccgcaaatggccctttataacagtgttgcaagtaaccaaagtgggcttaacacctttttctatcatttcatcccacaccctgaatgcctcacccataagtcctaaactgcaaaacccatttatcaaaatgctaaacgatacgtagttgggcaatatccccctgctcaccatatcacgccacaactccttagctttctccatttcaccaatcttgcaaaagccatccatcaatgtattatatgtcacaacatcaggcttaaggctcctttgagtcattgtctcaaacaaaccaagcgccctactcatgttcccatccttgcaatacccatgaatgagagtggtaagggtatagtaatctggaaaaactcccctctccaccatctccttaaacaactcatcggcatcaccaagcatcttccccctacacaacccattcaacagagtattatacgtaaccacatccataacacaacccttttcaaccatctcgttccgcatgtttaacgcctcagccacattgccattcctgcaatacccgtcaataagaatagtataaatcaccgtatcagcaaccaacccagcacccttcatcttcccaaaatactccaacgccttatggaagcgcccgttcctggagaacaccccaatcacagatccaaaactaatcaaatcaggaacaactccgtactgcaacatttcatcaaaaaccttctcagcctcacaaacatcatccttcctacaacattccacaagcaagggattaaaagtggcagcatcaggactcaaccccatccccaacatctcatcaaaaacacccctcgctctcacataatcccccttcttacacaacccattaacaatagcattataagtataaaccccaggcttcaacccgaggccccacatcgagttcaacagctcaaaagcctctaccacattcccctgacgagaatgcgcgttgattaaagtgttataagttacaacatcagagaaaacacctttcccctccatttgggacaagaaaaccttaaccttgtcgaacctcgcctctttacacaaagcattgaccatgatgttgagagtgtagacatttaccgttgtgccacttgcgacaacatcctcgtacactgtccatgccaagtcgacccaccccactttgaccaacgcgccgagaagcgcgttggaggcgttgatggaaacggagaagcccttttgcctcaacaagcggaaggcttcggagccttctcgaagcttccgggactgaacgtaggttctgatgagcaaatcgagaacagtggcgttggtgggagtggaagtgggagtgggagaagaaggaaggagggaatcgatgagttgggcgcgcgaaacgccgcgttttcggatcattcggaggaggagggattgggcttctgggaggttccgggcacggacgaggtcgtggactgtgggacccgcgtgagtggagttgcggtgacattgatgaagaaggaaagatgaaggtctgagagtgtgtatgtgtaagcgtaggttatgagtcagtagtgtcttcgccattgatgccaagggaaagaccagacacggaaggaacaacactgggaatgaaccctcctactagcatgacatggaaactttttgtttttctatgaaaaataaattatatgtttttttttttttttcttgggtctaagaaggtatggtgagaatttatatataatttaagtagcacaatcaaagttttttctattcttctattatttgatttatgtataagattttattcaatccatgcttggaaattagtgattgattttatctataaaaaatttgaattttttttaaatattctttaattcattaagtcaaatactaatctatctgtgatttgtgattacaattagttaaaaaaatcattatatcgttaaaaaaattaaatttttaaacacaatttaataagtatttttttattgaaaaagataagttgttttcatgtattgaaaatttatatcttatgatatttttaataatttttctcttttaattatttttatatttttttcttcattcaaacgatttttttatacatataaataaatcccaaatttattattttaaattattttcagcaacttaattataattatattgattataataataattattaaaataatttaactcctgtaattgtcctaagtacacctatcttgttaaacctaatcaagcaaaagtttatatgtgttttaatgaatgtgttagagaggaaaatgatgtggttaggagagtgttataaaatgtgtttttagccctcctttctttataataacttttgatgaaaaatgggtggctcaacttctctttttaaggagaggactattttttttaaaaaattgggtcaaacacaatataaacaacaacttgaataatattattttgttattttatcatatatttaacacaaattaaataatgataagtgatgatgatgtagtgatgataataataataatgatgataatagttacaataaagataatacaataataataatgataataataataataatgacaataataataataatattgttggtgtcaataagaaaaaagaaggaaaatatttcagtgtcctatttattctattacaattcatctcatatgaaaaaaaatatagcacgcaaacaagatatgataaacaatggataagaaaattagggtatgatgagctaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatatatatattatagatttattatattactattatgatactaagaaaacaagacaagatagtgaggatactaaaagtatatgttagtaaaataagataaactagtttatcatattctatctcaccatcaattgaattttaaataagataggtatatgaacatttgtacaatgatggcatttgaattattcgaaaaaaagtgattgcatttgaatttacttatttcactttttaactatagataataactttttttctttctaatttttgttattttttttttctttcagactttcactttatcacaattaagacatgactaatggtgtatttgaattatcgttacgtagcttcaaaatgtctgtttgtaccttttaaaaccctaataaaagaagaaggaactatatattaatcagagataacttgagtaatgttgaacataaccgttttccaaatccacactaacaagtataatttccattaatcattttcttttcatttttcttttcagtgtccactcataatatctctatatttaagtaaaaatctagacgtacgaggacgaaaataacattaagatcaagaataaaataacaatcatattactaccgtgattaagattaagattgttagttacaattttatttaattctacgattaaaattacgattaaaataacatgttttatttaaaatgcattttactatatttagtggaggcaaatctgatttatttatcaattaattttttaggaatgcaaagattgattagaacgaacaagcaagcaaaatacggacataagacgaattgaatttgtttcttctccctttgtctttccaccttcaccagaagctcctttctctgttcctaagcggagttagagggtcaaattgaaaacgcattcaattgcatcaaacacgtttttgttaatgttgttgcattctcttttcatattgccgtaaacgggtcctgtcctcgcttttctcacaagccactgaatttttttgcacctttcaccccaaaactttaacagaggggcgttgttcacggcaattcctcaccccaatggaaggtattgtgttttcctcttcaactttgcccttatcagagatttgggtctttgattttgtggttgatttttctcagattacttcaatttccatcctttgagattgattattggaacccataatatggattttttgtgttaggttgttgtaatggtgggtatggctccaaggtcttcaatttggggtatttggggtctgaaaaagtgagtcaaactgaagggtaccaatggggtttgattaatttttatcataattgaaacttagtttttgatgttttgtgtgcatttttctcttccacgttttctttttctatggattggagaagtttttgtttgttctgtcaatgaccatttactgtgtctaggcttggatctactttccatgtggaatgtgtggaattaggattggttgttattgttcctcgtcttcttgttctttcatacttggtggtgattggcacaaatcgtggttctctgcggaagactctatgaaattataaattctctcaaaattattctttgttcagttgagattagaaaactctaaagaaataaggaacaggtactgatcagtttcatgtaataagctggttgtatcaaacttgtatcatatgacaaatggtatgctagtggttgtgagtcgtggaaaaatcgtggtgggaagatgacacgagtgtatagaagtagaatgtattgatatcttagataatgaacagatttttctccagcgactttctaaattttgatttatttggctgtccacttccctgatttttttaactgcacaatactcactcttgggattgccgctcccttctgccttatgatggagattggattatgatctaaatgtatattatttagtattttaattttgatttcatatttagggtaattagttagtttgtgttatcttttagatttaattataattatcttatgtttaggggtttatctttattttgatggtctatatatagaccctcatagtgtagaccttatgcatgttttttctatttaataataacaatttctttttagagagtatctagtgttatcaattggatgtaagtagagcttgtattgttgcattgcatttacttagtaacttgggaccacaaaattcattagctatgtgttagtaactcttcagtgatcctatggaacaacctcctaacctttggacattgttagtgaaggatactctatagtatccaagcagctcccgagttatgcattctcctttaaacctcttttttttttttttttttttttttttttttttttttttataattgcaaaatcattttcttgtaaatatttgatctaaacaattcactttttaattcaaatttaaggaaagaaactttctggttcttataattatcaacatttcacatgagcaacttgacttcaattgcccatgcatgcatccttttccatattgtcataactgttcagcacctcagcatatagttgtatcttttgattcaataacatttgtggatcaatttgagaggttaatatgagataagatgttttttgattgttgtcttcttgcatatattactgtaattattttttccattccaacacaacacgtgtactaaacttcctgcatttctgttggtgtttagaatcaagtgaattgcaatcagaagaaaataaagtctccaatgagaaaaataagaaaagaaagttgaaaacaccggcccagcttaaggccttggagaatttttataatggtaagaatactttttgtaaatgggtgttaatgcattttccaaggtggtaatttttgagcaatttcctttttttttacctttgtttccagagcacaaataccccacagaggaaatgaaattagtacttgctgaggagttaggattgacagaaaagcaaatatctggatggttttgccacagaaggttaaaagataaaagattgatgaaagatgaagctgttgctaatgggcgacaagatcgttcaagtggtgtcatccaagatcatggcagtggacttgggcaagattcatgcggaagcagtaagcatgctgatcacaggtatctggatcttaaggaggttgagagccatggcctctacaatcacgaattgtcagttgcagatatgagtcatggatgtaggaaccgttatcctcaaaatgttagcggggtgggtgacacatcatctgagagcagctcatttttgcaagaaaggttgttttctcaaggtcaggatccatatgatatggagtcttctagacatcttacacctaatggagctcttccacccctaaatcccaaaggtgcagttaacatgggacacaaaccatcaggatatttgaaagtgaagggcgatatagaacatgctgctataactgctgttaagaagcagttaggaaggcattatctggaagatggtccactacttggtatagaattcgatccgcttcctccaggggcatttgaatgccaaactgcagatccagctaatggtagtttgcaccatattctattttcctactttttaaatgtctcattcagtttgttttttaatactgaaatgttgttaagtgttgaaattgaaacaatgccatattgggttaaaggaatgtgttgttacacatcaaattgtgaaaaaaaaaaagcgtatgaagcattattctttttttttttggtcataggcagtgaatgcttaaagatagaactgggtgtgataggggatgaattgtttttggaacagtaaataagtgtttccaataccaaataacctgcatcatgtttatatgctattcattgggatgatttagatgcttttacggaatttaagctgatgccttcttagtattgatactaatagggtcaatgacaatcttataagattattttatggtctatattattaagagcacttgtcaaaagagtgtcacttctcataagctagtgttttaaggatctaaggctttggatatgagtttttagcattagaaccaagaacttaacaaaactacaaggttttgttcctttgtgtagatcattttacttcttttcttttgctgatgtcttgcatttttatttgcttgttttttaaatgcccaacgcacatacattgaagaagttgcggttttgttatccttaaatttggaaagctcattcctaaagactgatactgccttttatggttcataatgtgtgcagaatgtgctattttacttgtttagttcaagatagttgatttttgctctttgggtgccttactggaaatatttcatcttagctaagttgtgagggttctgtttcgtttcattaactctagaccatttttctaactgcattgagtcattttaagagtagattgagaattgggattcttacctttataatctaatggatgctatggcagaaccatactctgttacaaatcctctgcttctgaattctccagaaatctctgctgcaaaaagacaacccagtcttagctctgtaagtgacctttctaattcatttttcatgagtttagcactgaaatactgtctgtttaaattatatgacacatgcttcaaagattggacagtgacctaattatttatgttaacaagcttatgatgagaattattatttatgttacaaacttaaaactagccctgaagatgtatcagaagattcagaacaaaacccaactttgacttgttgactcccgaattaatttttttttttttctgaaaggaaaatagataattttgttaccaagaccaatatcaagcaccagttgcgcccgaattggatgaaccattacaagaaattatcaacagtaatgtgctgcttctgtaatgcaattacaaacagaggaaaaaaacatatgataaagttgatttatatctgttgtttcccatgttcaccaaataccaccaaatccattccttcaatattttctgtcacactccacaaagccaaaactgcagttacacaaatgtccctcactgagatgagtatgataatcaactttatgattccaaaccgagctgaaatttatttccatgttgttcgcttcttttgacatcagtcttgcaactctcaaaatttatgacattcttttataccattccctacctttaactgacctttgatagcactacaattacctcttgttaccaaaccaaagatcctgtcacccaccccttaccagaattttctttttaatctctctcatttttaagttttggatttcttcaaagtggtaggaaaaggggatgctatcatcttgccatttatattggcttcagaatattatgtagtatagttcaaatatggtacagtgttatggtttaggaatcagtggtaatgagaaagaaatggattggagtggttattcccattacaagtcaccagacagagttggtgtttgttgtattaggattagaccaaactggaatgaatggaatagcttattgacaaaaataatcttggatttaaaaaagcaaataataaattttacttttaattttttaacaatataatattatgcaacatatgagttgaatgcacacacaatttgtggacagtttttcattttgttaaaatagtttaagataaactttgtcaagactcgacaaaatagcaaaagattcctttcttagtgggaatgagcttattcttggaatgagatttctatcctaaaacaatgaatggtgattccccaagaatgataagtaaaatgtggctaaaatggaatgtttatttttattgagctaaatgtgacccttttacttcttacagatgcttaagaggaaagaaaaaattaagtgctaggggcaacctttccattgtttcaagttattctgactgcaagttaaatttttaaatggactagaagctgtgctttgctttataagtattaacagtaattttatacttgtgcttgctcaatcctcatgtaaaatctttgcattgctgttgagcagttttaaacttatcctgtttataaacataacaacattgattatgtgatacaaatttccctgctttctcactctcttttacttgtgtatttgcagagatatgattcatattatactaaatttagttcccaagatctgcatatggaaggagcagactttggttcctcgcatgaaactgattttcaggataaacaagataagaaagcgcaccagaatataaaacgaaggcaacctttatatggttataccggttattttcctggaaggaactctttcccagatttgtatgaagcctctactggagaagcatctgcttataatagcaccaagagtcatagaatgagcactaaacatggtgttgaggggatgcgatctgattctgcttctaaccatagtgatcactatgaagagaagcttgcagttaagcagaaaggcttgatgctgcatgataatatcaatccaaagaatatacaaaggagtgaacatgtaaaatctaaaccttctagttcaatccgtaattcccgtgttcctatggatactgaagaacgggggttatctgctaggatggcaaaggttcattaatatatttacaccctctgtgtgttatatttgtaatggtcaatttgtcttgcttacagatggtttaaaatgcttaaattttgtgtcaaatgtgcaggaagagatgtttaagggggacaggaaagcaaaaaatacataccgcaatgtagatggagcagggatgctttcaaatgaaatcatggttagttttagatatctaaattttccttttggaatatgattatttgatttccttttgagctcattcccctccttccaagcatgtatatgatgttttgctttactatatgcataggttgcaaaacgagctaaagttgacatgcttcaacaatacaatgtgaaaaaatcacctgttgctgagatggaacaaaggaaaattcagaggtgggtatatatgcatgttttgtttttgtctctaatgaccgatcactcaggtcctcaatagaaaatttatagatttataaatttatagattgtgtgcatgtttatttaggtagcgtttgacttaacttttttttttaggttctcttttctttaaaaagagaagttaggccaaacataattttttttttttaaaaaagcttttaaatatatgactagtttttttaatgatcctaaacccaaaagacaaagtttatatagaataagctaattagtagagcttttacttttaagaagaaaagaaacctaaaaaagctggggccaaatacaaccttagtagtatttatttttgtgtttagattttttgttttcggatgaatgttgcttgcctcatgaaaatgggataagggttcttctattgcacatatgctaacagtaataattgtgaaggcagtagacagtaatgattgttggaaatcaattataattttttgttagcagtaaagatcaaacattcaaacatgtagtgttatcaacagtcgtcatgtgtgtttagtttaaaaaagattataatcaaaacactagtaagattttggctaaaaagctttctttgagtaaaagaggatttctaaacaccaggtgtggccgagtgagtaaattgagttccatgtgggtggactttagtatttaaattccccactagaaccatcttttggtcaatgtaaaagcctatagccttgcatggattagtcccacacatcatggtcttacccaatttacaattttctattctatttttccttagaaagttttcaatcaagttgttttgggatatgtatagaggcctcttttctaatggcattttatatgatcatgcagatctgctgcagacttgccttctagctttagcgaggatgaaactgctgacaccagttcctcactggattattaagtgctgttgataaatgctaacaagtgtgtgggatttctctaagccattgtgtatgtacagcctaaaaagacatacattttctctgtaacgtgggaaccattgtttctggcagcaatggcagtgactcgctccatttgctgttttttgttctcacctatttgcctttgtaaaaaaaaaaaagtacacccgggttattttttggatgtaaaatctcatttcctgaagctgttcgtggtaggtttaatgcacagcttatatacttgtcatttgtcttttattggtttaatatggtagtgtgtatggcatcctaatttgctccaatttgatctctttctttggagagttggctacttctactttatgatttaacaattcgtttcatgagttaggtattgttcacccaacactcatatcgatctagtgaggataatattgataagtagttgagattttaacttattagtctcatggtgcatattccccatactaagtgtatttgaattgacgatgataaaattgattttgaataaaattgattccttacttgtgcatatgaaaaaatatctagtgggagaggtcaatcccttaaatggattttagtatctcgaaagattagtattggctttcggctggggaatactttggttgtaatttttttttttttttatagaattgattattgtagaattgattttggtagaagtagaagttatttttatttgcttttaactttatcatatttttttaatcataattgattttattaggattttgaaataatccaaacatccaaaaatttggtcaaaataaaggttgaaccacctcaccataatctaccataattttagaggctatttaaacacacactaaattatcattctcgcttaacaataatagaattatttgtaatggaaaaactgatttcttgttactgaacctaaagtaagcaaccctttcttgggagagcttagtccattttattgggaaggaaaaagacacctaacatatcaaggttaggaatcttaatggagaaacttcaggattacatgtgttaccatgttagaggtcccaacaaagtacagagtataaatataggaacttaggaagagctttgttttagggcaagatttgcttatgggagaggtacattgagtttccacgtgttaccatgttagaggtcccaacaaagtattaatatagtaaaaattcagtaaaaaataaagcagaactgctcaaaattagataagaactaacttgaactatttttgtattctcatattatttaactaaataaacgtatatatataggatctacatttgaatttattattattattattattatttaaatatttattatattatttttatcttgtaggacgtgtaatagaatttttcatgttaatttaatttttttaataatcttgtattattttattatcatattatttaactaaaataatattataattattagataagaactgctcaaaattagataagaactaacttgaactatttttttaatgtctttttaatttttttattctcatattatttaactaaatatacgtttatatataagatctacatttgaatttattattattattatttaaatatttattatattatttttatcttgtaggacgtgtaatagaatttttgatgttaatttaattttttttaataatcttgtattattttattattcaatatattataaagattttatttaactaatactttagcttgtgcatttcacggtataaatatttattcgatataactaaaatttataataaatacatatttgtaaatatataaattatattataattaaaattggtaattaatatatattttagaatatataattatattttagatttatgataaataatttatattattatataatgttagttttaattattgataatatattttaaaaaatattgaaatccaagttagaactaaaaatattgaaaatgatagattgaaatagattataggttaaaaatattttctagaaacgcttttgttaaagaaaaaatctaaaatattttcgttaaataataaccaaaaacactctctttggaaatagctatttctaatttatatatggaaggattagaaacatgtttatatctcatctctatccttgtgtctccaattttttttttattttattttatgatttcctccttccttcctcattctcctatgattaaaaaaaaaagtctcacatatgtttcgaaaataatgaatacaaacaaaggaaactgttcctggctaatatacagagaaatctaaccattcaatctcaagttgggacatccttctgccattgattttgaatttggacccttcatttgttaatttggttgtgtttttggtctatcataaaaaatataaaaaatcacaattcggaaagacctaccaaccttttgttagggtagtggcccaaggcaacaagactggttgtggttatgcgggtgtgggactgtgggtggtgtggtgcatctagaaatctctcctcaatttgcatcttaaattaagcacaatccagaggccaattggatgcctaatgctattttattatgtaaaatgtacaaatgtgtatgttgttttgtgtgaattggttcttaccttttggattttttttttccatcaatcaccaaatcctagtacaatggatacctgactaggaaactgttaattaaatgatgtatgtagtagttcgtacttcgtaccctgttctttattttagtcataaaaataagataaggatgaactaaattaatcaatcggcgcagaattggatacctaagaaagcatgtgccgaggagggctttcatcaatcttaacaaataaacatgtgttttctacggttttcgctcattaaaagtttaattagtgtagggtattaaactttctaaacctaacttgtgatgctcttaaattcagttgataaattttatgcccaacccttcttgcatagttgcatattagatgtttagatgttttttaatgcatccaaaaacaggattgttttgaaaatcaaagaagggtacctaaggctaaaatcttgtgtcggattctttttatagggtagcgttttggtaaaactttataatttatcgtgcgtgtacgtgtgaatgcaaatggctaaatcatatcatccattattttttatgaaaaggtatttcatactctttctattgtgtgttactatctaattagttaaggactctacaatttgtacatttatataatttcttacaatcatcaaactaattaaatttgcaaacaaatattaacttctcgtaaaattaatatccaacatcacagtttcaaaaactgaaaggtatcatggatatgccctagagtagattcaagtcaacttcccatactcacagctaagaaaatctaacttgaatatgaattttaacgtcatatggcgcagatcctccatagggaattggggattaattatgtatataacaccatactatgaatctgagccgagaacatgaaattacgccaaaagatagtttctctttaataattgtagggcaaggaccacagtgagccacgcagaatggattgaaagagtaacctctcacaatagtcatgcttaaaagaagagcactaatgctaacattgggtgaatgataggttctctctcccatataggtcaatttgacaaataagctttaaaaaggtttggtcgacttcacaaaataattgcgaactgaaacgttacttcaatttgaagaacatctaactctacattaccccatatttcaaataattagatattaatgtccttcccttggtataatagcaccatgtcatgaaaatatagcttaacttatataattatatgctaataaattttattatagtttaattatcttcagcttttgcttttatctgaacttaatttaattaacttcattttacaaaaatattgagtattgagttttattattgtaaatctcaagagtgttgctttatctttatttttcctttcctggttaagcattcagaatattcttcatgagcaaatgtattatgtataaggatataagtagtgagcagcgttgtcaaaatcaagtcgtactatttgattcaacaactaaattggtaaattagttaggtaatagaattattagattaattatacaattgaatcaatgcaaaccgatctgaatcaaatctaaactaggtttaattagtattaggttaaaatgacacgtaccggttttgcaaaatatgtactgcaaatttctataattaagatttaaattaactaataacatgataattagcttatgttgcattaaccattacattcataacaattatatgttaataaattcaaaccccttcaacaagtcatatatattcctctacaaacgatagtattactcttcttttggcaaattcaagtgacaaagtgtgtggggtgagtccttacaataaacacgtactctcactttcaaatctctattattattttggcaaataaaagactcgtttaaaacgcagaagaattttagtgtcactgatatgctagaatatgctagataaattttatttttgattcgcaagtttcaaatcattatcaatttctcataaccgatccttaaaataaatatgttggatcaatccagagctattattatgtaaacatactactgtttgtgacctaacgtgtgaatattcgaaccaaaatcaataaagatgcatatcaaatttagcataggtagtgattcatggatatataaattttacagaggacataaatttgaaaaggaactcttggaagtacaatcttttttgtgcgtgaacttacatgctcatgtaatttgtgtcaatttaatttatctccagccaatgcaacacagcaggagaaacaaagataaatttgtaaactatatattgaattttatcttcatgcgtactttttaaaaacattccaaattctatacatgatttccttttcccacatgatatgaaagtaacgtaactattatgaattccaaggggggattcgatcgagagcaaattaaaggcttttgatatcatgtggtaaagggtgcatctgttccatcaccctacagtgtaaattctgtgaatgtgggactaagagaagttagaaagtgtagggcaattaggaccacttgaggaaaagaataggggaccatgaatttctatgacttgtggctaagggccaacttttccaaaaaagtgtaccacactggacagtggtgttggtctcaatcactaacaagggttggaaagacaagtgccattgtcaaagggtatcatgggtgtttgtgaactccagccatggtgcacatgcatggattgattaatttgaagttagttttttacacacactcacccaatggaattgatgggtttttgcatgtccccatttgctagatcttttttattttgttacatcactttacttgattgtgtgtggagtttaataacttcacacacatcaacctcatgaaacaagctagggtgaaagcaacccacaaagttaattaattttaaaaaataatacaaacagggtgagtgaggcttatgataagaacccgctcacgtactgcgctttcagtgcctaattattgccatagctgcagcctgcagtgtgctggagacagcttaatagatggttcggttaaatcatatgtattaacatattaacgttaatgttgtctctaaataaacctaaagctaattttaagatggatttaaaaaaaattaaaaaaaaatagaattttatccaaaatttaaactattttggtaaacatgggatatctagtcataatgaggcactattctcttaaatgagccaatctctcttgagagatatttttttatatacacaaacttagaaattatacttttaatcacatgcttaagggtcactaattatttcaaagacaaatgaaatatttgaaaggtttgttgaatttcttataagattcaaacaattagaatgagagtgtctaaaccatgaaatattattgtattgacatgattttgcttgattgaagtaacaatttgttgtaataaaataaatagaacaagaacaaattctccgtagatgaatcattttatgaggaatgacagtcatcagagatttttcttgctttgttaaagtttgttttccctattagaccaaactttccttttgaaaacaatgttttctctattgcaatagtcaacctagaaagattaaaatagcttttgctcatgttattttaacaatatttatagtgatttgtgtttttttattttcaacaaaaaataagaattgctcaagaggttgattattttcattttcatcgaccacgacatgcatggcttttattcctaaattcataaatggttaatgagggttattaagttgggacaaaggtttgagtcaggtgggtgatttgcgtggtatgcatatgtagcgtcagtcatatatcgatgaaaatagtattaactactaattgtcgacacaactaatgacaaactgaatgcatactttaatagtgttactttagagtttgccatgtggtcactacacataatgttgaccacttttgaaggaagttttaaaggtagctttgatttttaaaccaatgtcatgttgcgtcaacaatgatgcaaacccaactattttgctttgagctttgtaacgtttaatttgttgaagaatcgatgcaaaatttgacacacagtgtgattttgcgttttgcgtcgacttttgcaatttagagttacatttgactaatgttaaatcataaatttcttgtaatgttagatgaagagtaatgttgatatttataagtataagatgggggtactaagtttaagattgatacctagttatgccaagcaatattttaagtgtagtttaggttctgactagctagaaaaccaaggaaccaattaatgactatgatctctaaaaaacgatgggttagagagtgttttacagatctttctctaaaattgtgacgatattttttttaaaatattttatatgtgttttattaacttcacttatttcatctatacgtttttaaactttcatatttttaccatcgatcttaatctttttattttttaacaaattcaaaatacaatatataaaatgtaataaagtaaaaagaaataaacatattttatcatacacaatttatttattttattaaagcggtaatatttttggagggagttaaaaatataagtttagaaattctttgtataggtcaaccttaggaattgtttctcaaccacataaacaaaaacaataacatattgaaacatctcaatgcgttgacaaaaagaaatcaaaagtgattctcaaatagttacgacaaacaacatggaagcataataaaattttgaaatgggattgtggaaaagctatacaagcattgtattgctaatgacaattaaatggagagagtccagtaaccaagagttgatatgtgatgaatggtgcaatggtggaatagttacaagaggaaaacatgaagaagaagaaactactaacacacccaagtctaggtaatttaagtaatggcagaagtccaaaataagactgtaacattaataatgggttgattaaggaagctactaacgtcctaacaaactgaagtcttcatatgataattgttactaatatagacccaagtctaggtaaattattcatgataaattaggatgaagtttgagcgaaattaagtgattttgaaaaattaacaaatgagtttgtagagcccaaatataattagtgagacaatgagagattaaaaaaaaagggattcacgcgggctgttagtcattatatattacttcaaccgtggataaatatataactgtaataaaatgccacattttttttatagtggtcactgttcagtggacgttgagaagggaataaaataattcgaataactgattaagggtcctatatgcctgctaaatgatgaagaaagtaggaatgtaaagacaggtaagaattttaactagaaattactacatttaagagagtacatatttaaactttttatcatttactatttttttaattttataataataagaatatagtaaaaaatgatggtcatttatttttaatctatggagggggacctttttatccaaatcaagaagtaaattagtcaattaccaaaaaaaaaaaaggaattgaattagtcaaggtgcggacaaattgattggttctatagaatttttagagcaccatcacgataaggatgaaaagtattaaaaaatataacatctttacatttttcttcattaatttaagtaattttcatctgtcacaccaaaagttcaacttgggttttcgaattgatagttgcatctcagtatctcagattgatgatgatgtataaagtgtttcagtcttcagaggatttcatagtaaaaactaaaaatgttattcagatgatggataaagggcggatgaacaccggtgaattgaatagtactaataatttagttataataataatttctcttattttagtcagaagtatttaattaaccaacacgattatttttaaatttgatttttaataaataactatatcaacttttctcgaaactagcaattttttatacatttctcgaaactagcattagttacacttattaacgtatatgtattttacaattaaaaattatacttatattttttatacattaacgtctattattttaaaaaaataacattactactttctctattttcatgtctagattatgcacatgatatgtaaaaagaatatttccttcttcccaaaataataattattctaacttattttacacagacaacaaaatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgtatttaatagaatagtaatatatatatatatatatcatagaatgaataataaaatagaatctatttaagtagagtaatactatggattttgaattaaataatattatttaatatttaaaaaaaatatatgagattatcatgtcacattatttcttagaattcaacctttttttatacataatatatattagattcttttcttcttatagcaattataattgggacagatgaataataaatttaggagaatgcaagagaggtaagtataatttttttaaatgaagaggtgcaaaggtaattgattctaacttaaaggaaaacaaacgtaaatattcatattttaaggtaatttttttaatccaatttcaataatttatattctaaaaatcattttctttaattttttagttcttattttcttcttaaattatacaccttttataatttaaatatttttaactttaaaaatattattggcatctcttacaaaatataaaaaataaaatcattttaatattacagtctgctccatatatagaaaaaggaataatcctgaaataatctcatctttagtcaccgccacccaaccaggacaaagcgattccggcattttcggcactgcaattatacacacatgtataattctaaagctacctttttttattcttcatttttaaaattctctttttaaataattgtgctttgtttttatcagtaataaataataatactcatagtattgactcaagtcaaccatgaccagtttatccttttttttaaaatatttatttattactcaaatctgtccgtttctttttaaacgtttttccttatgcctgtaatcaaccaaaggaatttagtttaatcagaacactaacgtaaaaaccaataaataaataaaagcgtagcgtaggggcaaaatcgtaaattttgacgacaattagggcgattcctgtgtccgtttcacttttcttaattaaaaaaaaaaaaaaaagaatttagcttgcttctgttttgagctctctctcacactcactcactcctcagccatagagacgacactgtgtttcttttttatgctttttttgtaattccattctgctttctctctctaaaacctcactttctcgctctctctctcccctctgcaactgattttccagatcatacttcctagattctcccattccgtttttccggcacttcctcgccgcgccgccgcgagctcgccgacccctccatcaccggaatccgcggagcatcgccaccgcaacctcgatcgcttccttccgccgcaacctagcacctcgtgccggtgccaatcgctgcttcggagcacgctggagcagttcccgcgccgcatgaagcagtggagcagcgctctagttcggtgagtgcccgacggaggcgtaattatggtggattcgcgcgccggaaaaggctcggagctgttggagcgagggtttgagtgtgcgaattgatgaatggaagggttcgggtatgagaacgggtgaatgtgaaagattagtgtttagatttgaggagagagtgaaagtttctaattagtgctattcgtgttttttttttgcgtgatgtcgctgactagtagaatggcttcggatcttagcagaaccggtcctgtggaaagagacattgagcaggtgtatatctatctatctatcttttttttgtccatttctttggtagctttttctctgtagcgtcgtgcttcgaatttcatgctggagtactgtttgtttttagattttgtgtatctgattggtgtgcttgcgctgtacagtggtggtaatgttcttatttgttgttgttgggggcattgggaataggtaattggcttaatttagctaggagcttaaaattttggatggaagtctagttgcaatgttttggttcgttagtttggctgccagctaggattgtattatcatcaggtcaagctagtttatgattggcagtgaaaaatcttggtgattttgagctgttgcttaggaaattttcttataattaaaatttacttaatgagtttgtttatacgtagttaagtatgtgttgtgacttctgaatgttgttcgaagatttggatgcttttttagtggactaaacattttaggtatttgactatgtgaatattagattatttttttcttgaatttatgtttcactaatttgaccatttggagatctttatatttaattatcgttctcttttatggattgtttgggtgttagataccatgttttgccacaggaatacaaggcaaatgcattatgctgttactattatattgactaatagacagtatgttgaatttttggactttagtagctgttcttggtgcttgtcagttgaatgttatccatgaactgtgcttattcattgattcctataatatgttataagttttctttatcttcagatgtgttatatatgctggctgaagtcttttattgatcttatcgacaggccattactgctttaaagaaaggggcctgcttgctcaagtatggaagaaggggaacgcccaagttttgccccttccgtctttccaatgtgagttttgtactctttatctgtagattcaaattaatccttgttaaagtgtgtgtgtgtgtgtgtgtttgtgtgagttttaaatacttatatttggcattaataactttgtccccgtatagtttcaaaacgaagctcaaacccttgattttctacattttattttgtatttatttattcttaaatagtggtgaaaatatttcttttaatggatagtagggttggggaccttgaagttgaatgacatagtgaggaagaggagagcgaaaatgtgaagtacttgttaaacaaattaaactgaaaattaagagatctaaaatcttcatggtctactagaaaaattacaaatattaaagaaagattaatcaattgcttaacatcaattaggattgccttaagattaggttttcaaaggtgtttgcactaacaacatattgaaaatttgataaagtcacgataattatggcattgagcttagcatgaattttcagcaacaaattgaaaatgtgaaaacttgattttgcttttagtaaaccattgtaagtgggcagccctgactagtttacagggaaaatttactagtgtatggttggatacaaccctcccgcatgagaatgatttgatctgcttaagacacccattgtgccaatattaaaaaatgggaaacttgcctttgaaaaacttaccaaatcttgttaaagcaagcattctaatccacatatctagaaggtatatttgaaggtaagcatgcatgttaccttattattgaccaccacaccatatcaaacacttttgtatttggttatgattatgcatgccatttatggaatcactttcatgtcatttcatggtttgaaagccatttgattatcttattattcccctaatcttgcttctggtttatttatattattttcataatttgaagtttgtttttagatgttttccagttgccaaaaaaataagatttggcttctctactttttcaggatgaatctgttttgatatggttctcagggaaagaagagaagcaccttaaactgagtcatgtctctagaattatatctgggcaacgcacagtaagttttagactgacagtgcaaagtcacgatactgttttgcttcttcagatttagccaacagtgccttatcatgttgagataactagttatgacagttctgttaaatttgatgtttgtatgattaatacagttcgtgtcacctttctctatatgcacttgtgatgtgagtgtgaccaccatgtgctggaagtcaagatatgtaaatatcatttatttcattatccatctacagtaaaaggatttgtttctttagtattatgaatagtttacaatatgcttgtttgtggtaactattagattatgttttgctttgagaaacatgatgttgtgtgctgtttcagtgtcctagtctaataagttgacatttatctaaaaagccattactcatgctttcttgactttcagcatctacagtgaattcatttcaagtgattaggttctctgttatgattgataaaacatggctcctacttttttcagcctatctttcaaagatatccacgacctgagaaagaataccagtcattttctcttatctacaatgataggtcactggacttggtatgaattttcttcattcctctcctcttggattttttagctgcagttggcccgttgctttgcttgtatagatgttattgatattgtgaacagtatcaatgtatttgtatgcagaagtttaacacaatctggtggtctgattctttttctactagatatgcaaggataaagatgaagctgaagtttggttcagtggtttgaaagcattaatttctcgtagccatcaccggaagtggagaacagagtcaagaagtgatggtattccatctgaggctaatagtcctcggacatacaccagaagaagttctcccttgaattctccctttggcagtaatgaaagcctgcaaaaggtataaacttattctttatgtcccttctattttctccatttttctctacattgcagttgaatatgtttattaagataatatttatttgtcctattcaggacagtggggatcacctttgccttcatagtccatacgagagcccccctaagaatggtttggataaagcattagatgtggttttgtatgctgtccctcagaagggtttcttccctccagattctgccagtgcttcagtacattctgtgtcatctggaggatcagacagtatgcatggtcacatgaagacaatgggtatggatgcttttagagttagtctatcaagtgctgttagcacatctagccaaggctctggtcatgatgatggtgatgctctaggggatgttttcatttggggggaaggcacaggtgatggtgttttgggtggtgggaatcaccgagttgggagttgtttgggtgtaaaaatggatgctctatttcccaaagctttggaatctgcagtagttcttgatgtacagaatatagcttgtggtggacgacatgcggccctagtgaccaaacaaggtgaaattttctcctggggggaagaatcaggcggcagacttgggcatggtgttgactctgatgttctccatccaaagcttatagaagctctaagtaatacaaatattgaacttgtagcttgtggggaatatcatacgtgtgctgttacactttctggtgatctttatacatggggtaatggcacatacaattatggccttctaggacatggaaatcaagtgagccactgggtaccaaaaagagtaaacggccccttggaaggcatacacgtgtcatatatttcttgtggaccatggcacactgctgttgtaacatctgctggtcaattatttacttttggtgatggtacatttggtgctttgggtcatggggaccgaaaaagtgtttcattaccaagggaagtagagtctctcaagggtcttcgtactgtgcgggctgcatgtggtgtttggcatactgctgcagtcgtggaagtcatggttggaaattcaagttccagcaactgctcttcggggaagctgtttacttggggtgatggagacaaaggtcgacttgggcatggtgataaggaagcaaaacttgttccaacctgtgttgcccttgttgaacccaatttttgtcaagttgcttgtggacatagtctcactgttgcacttactacctctggccatgtctatacaatgggtagtcctgtctatggccagttaggaaatcctcaagctgatgggaagctaccaatccgtgttgaagggaaattgtcaaagagttttgtggaggagatagcttgtggtgcatatcatgttgctgttttaacttcaaggactgaagtttacacttggggcaagggtgcaaatggccgtttaggtcatggcgatacagatgatagaaataccccaacattagtagaagctctgaaagacaaagatgtcaaaagtattgcttgtggaactactttcactgcagctatttgtttgcataagtgggtatctggtgttgaccagtctatgtgttcaggctgtcgtatgccatttaatttcaaaagaaaacgccacaattgttataattgtggacttgttttttgtcattcatgtagcagtaaaaagtctctcaaggcttcaatggcaccaaaccccaacaaaccttatcgtgtctgtgataattgtcttaataaacttaggaaaaccgtagaaattgatgcttcatctcattcttctgtgagcagaagaggaagtgtcaatcaggggcctctggagttaattgataaggatgataaattggatttcagatctcataatcaacttgccaggttttcttcaatggaatccttcaaacaagtggaaagcagatcttcgaagaaaaacaagaaattggaattcaacagcagccgtgtctcgcccgttccaaatgggggttcacaatggggagcattgaatatttctaaatcttttaatcctgtttttggatcatcgaagaaatttttctctgcttctgttcctggatctagaattgtttcccgagcaacatccccaatatctagacggcctagtccacctcgttcaactacaccaaccccaacacttggaggtcttgcatccccaaagatagttgtggatgatgctaagaggactaacgatagcctcagtcaggaggttattaaattaagatcacaggtatcttactttatgcattcgtcaacagtattcactttcttgctgtaaatggtttgaatagaaatttaacaaaatggccttgtatggtaccatatttttttattacaactggtcattttttatgatgttaatttatgtgaattatgtctgatgaaatgagctatagacactgtggaaatgaaggcaagaagggagtcatatgcttattatgatagtttatactttatactattatgcttggatgtagatagcaagatgcatattcattgcaagtcagtgagttgctcaattatttgctgtattgtatgataataatctagagatgaattgcaatttaaaatccaggtcatcataaagttaccatatgtgtgctagagatgaggtatttccatgtaaatttaaatatattattgcaatgcagaacatgtggcaagtcactgttgaaggtagtcagggtttgtgatttatacttctatctcataataaaatattaacaataacagtgagtagatttttattttgacactgcacttttttctttaccattgtgttttggagggttcaatgaatcaattttaaagaggttatactgttaacaattcatttttttcctaagtagtttttttcccttgtaggtggaaaacctgactcggaaggcccaacttcaagaagttgagttggaaagaacagctaaacagctaaaagatgcaatagcaattgccggggaagaaactgccaaatgtgaatcagcaaaggaagtaataaagtcacttactgcccaggtagaaactttaatcccttaaactactttaacaaattagactattatagccaaaactcttaatcatgaagaaagcaaaaaagagcaaaaaactttacatgtaatgggtggagccttttctttttctttttgaaacaaatcaactgttatgtccaagaaatttttcttagctatagcaatatagtcaaggttgtcttaattactaattgaccctgaaaataaatagtaaagccatgaaatgttacacttaaagtcatgcccgatatcaatttgatgcctaacatagtagatttttttttttaatcttttaagcttatataaggtatgttcttgatttgtactcgatgtatcttaactaggccaactgatccaacgtttatttgttacttgtgctgagtagttgaaggacatggctgagaggttacctgtagtagctgctaggactgtgaaatcaccgactcttgcttcttcttttggttccaatccttgttccaatgacgttatctatgcttccgttgatcggttaaatattcaagcttcaagcccagaggcagatttaactggatcaaattaccagttacattcaaatggatcaagcactgtcagtagccgtagcacaggacacactaaacagagccagtcagattcaacaaatagaaatgggagcagaactaaggacagtgaatcccgtaatgaaactgaatgggttgaacaagatgaacctggtgtatatatcacactcacctcccttccgggaggtataatagatcttaagagagttcgcttcaggtatgcaatgctctgtagactttgtttctctgtcagaacttcatctgtgatatttgttaatgtagaatatgatatactttcatagaagaaaaagtagaatataacatggtgttaatgccttgacaaaaattattcctacgtcaatgacacattttgattctaatggcaatttggttgcatgttcttatgtttcatgtctaggacagttgcatatttcctctatttgaattttgaaagtagaaagtaatttcctaccgtaatgtttatagttttgtatctggtgggacaattcagataactccacactatttcacgattaacaattttataaccttaaagttggtgactgcagtcggaagcggttcagtgagaagcaagcagagcaatggtgggccgagaatcgcggaagagtctacgaacagtacaatgtgcgcatgattgacaagtcttctgttggtgttgggagtgaagacctggctcattgacatgacaacctgtaaatgagatgtttttcgacattttggctgggattagggcaagatcgaactgatcaattacatttggcttccatctaatataaaagcgacgagggaagcttagggggattggcatagtaggagagaaaatagggattgattgtgattttgtaattcctcttcgttttctttaattttccactttgatttcactttccatttttttccctatatgatgtaccttgtgtgggggttgagggtgagaaatgtaaattcttagtaggttgcaagctctgcttgaaaggagctgcagtgtaaatttcataagcgaatgcatttgcaaatttttcttctacacgggatataaattccctcagccatgggaaaaacggctctaagtagttaaatatacatggccctgccaattgcatatttcatatttgtattcttttttttcctgctcttgcacttgtagtaataccgagttgggaacttatctaacgactaacgagcagagaccctagcgggctgcgccactttattcattaatcttaacaccgttgcattttaattgatataggagttatttatattttaaatttcatattatatgttaaagtaaaaaagtgctatgaaacattagttaatttttaaataccttcgtgtgtttggatgggggggatttgatagggtaattcaattttttaaagattgcttctttgtaaaataaggtgtttggataaagaatttaagaagaattttcgattttagtattttaataaactaaaatcttaggatttcaaattccttcaaaaatttaagaaattgaaattcttgatgcagactcgttctcggtatgctttgcttctctcacgttgcacgcatgctctcatcgcaaggctctttatgttgtagagtaggatataatgcctcatgttacgcccttgttcgatattgatgcctattgattttatgtttatggactaaacgatgtttcttggtgattttgaattaaatatatgagatttctatgtttggatggattcgtctctgtttttctgaatgcaagtggtgttgtgtgtaagaatggttcttacttggtggccctacaggtacaattgttgtagtattaagcctccacaaaagggttggcaccatgaatatgaaaattcatgttgtttcataaagttttggaatgctgacagaacataccaaaaattggttctgcctttgttaccctttaatggtcattgatatagatcccaatacatatacatacaacattttcttttcttagctatctacataaaatgttgcagttgaaattttagatgcatgtccaaaattcaagtttgcgatgagatgtgagagtaatagatgcatgtccaaaattcatgtttgcaactagatgttaaaaaaatatgaatttatttgtgatgggggtgcctgattttgtaacaagcagccacaagggtttttggatcattgtggtgtgctgtaaggaggagaatatactttaggcactactctatttgttgaagattttaagtggaaatgaaaaaaataaaataaagggtgcgaagttgggttttctggaacaagtgttgtaggattaatttcatgatatatttatgatgcctattcatataatgaataacttgtccagtactcaattgctatttcaattcaggataccaatttaatcattcaacatatgttttctgtgagggttaagaaaaaacttatttatcttcaccacagaattgtatatgcttttctgttttcataaaattgtctcatgcctatgattttctcgtttacttttatccttccaatgaatatggtccttgcacttgacttcttacataattttaattcttcctattacataattttactaatctttaagaacatgcacttaggatatataactagctgctacatgtatctagcttcaacagctagaatagatatgtaactcattttataaactcttgtacataactactggatttgattgatgtaatctatcttttcagcttaagtgagcacactacccctataactttccctgatataatatgattgatcatgataaaaaagatgtggaagattaattattaatgatgtatcattgattttatctttttccatgataccaatgactaattattatcaatgtctgtcatggcttagaccaagtcttttatgggtttggtaatatgatatcacataaatttacagttttaacaaaactatcaaattaatatttgttgataaaaacaaaatatgacatcatgccaacagaagctaattattactttactttcactagaattttaaacactttagcactcagtcagtgatacgtatggactgataccaaatgtatagtaattgaaatttgaaagattttaaatggtaaagcagtgctaaagataggattgttgaagatagagtagatgttttatctagttgtaattggagttggataaataatcatggctacatgttttatctagttgaaaattggaattaactatttgactccaaatcaagggttagactttaatttgttgagtgagaggttagtgtgatactaatgagtacataggcgtgcagatagtgttttttgaaaagaaaaagctgagcgtgagagaagacgagattggttgtatagagaagagagcatgcgatgctattagtggtttcctgaattcgcatataggcagtatcgtgcttggatatatatggaaagatgcatagacaaagacaaataaaacctgcaagttgtaaccgctaaggacttggaacgaaaaaataataatatatttaatgtgaaaattataagaaagtggaaaaaaaatcatgaatagtaaaatttattgtctcccaaaaaaattattttgacttttaaattttaagttccttaaggtatgagtgttattagacttgatttttttaagaaaaatttcatgttcaagtggatgaataaaaatgtaatttaaagagaaaaactcattaaagataatcgaccaatttttttaacaaagattaataaaaaaaatccatgaatatatactccataaaacaatagattccttaactattgtctttaggttactaattaacatttaccatattgtattatcaacttcttacatgcatttttttaggggtcactttctcttattgttattcctaattttgtttcattctgttttatattttgcttttttcgtttgtaattttttttgataaattcgtttgtaattttattggttactaataaaaattatcatatgattttttaaaaagtagttataataaaattcaataaaattacagactatatattataatatatttttagttcttttaaaataagtaaattttgattttgatcatggattttttattttaaaatttaaaatatttttgttcatgtaaaatgagaaaatttcaatttcgatctttgtataatattttttttttaattttcattcctccaaaatctgagaccactatatttaatatctaaattaatatttgagtgcataaagaatatttattttagatttttaaaaaaattagaagagtcacgtgcccacataatatcataaacaactagtgtgttatccggaacgataaattgactttctgttgaaaacataaactgttaatgaatacaaagataaaaataatgattttatatctttttgatagaaaatgaattcatatctttaagggataaaaaattaaaaaaaaaaactgatgtattttatgcatagttttaaaatctggaccgacctatcgaatcggaatttggtgattaaatcgggtagagtaataagtttgatcggttacgtttttgacctggaataatcgattgacttagtcggatttgtggtcaaaccggtgacccgttggtccatatcgggttacttatcttcttcttttttcatttttttttacttttttttttgagttaaattgataaatcattcattgttgaatattttttgtggctacaattacatttttgtttagttaaattaatttagaagtgactgtaattgtggttgagttacaggtgaaattgtaatcacaaatcattttttaaaaatgtcatttagaattttagattgatttttttatattttataatttacattgatatgatacggttatgttttattttaatgtaaatgtttatatatacttccattgatgcctttaatgttaaatgttagagataatagtcattttttaacttgtattttttatattttatttgtgtttttaagatttttgaatttgaatgtattagaagaaagattttaagatagatataaaaaatttatattttttttattataaatcagatcatacaggttaattagtgatctaccgattcgaccactaactcaataatccaatactataattagattagtaataagatcgattttttaaaattatgattttacgttaactaaaattatatttaagtttttttaataagtgtccattgatcttgtatcttcgtacttttctttaattttgaatcaacaaaggagtacataaaatagaaaaatcacattttttattcatcacaatattttttcaatttatgtggtgctataaaagtataaaaacgtaattatatcaaataatctttatatatttagaatatattacaatgtactcaataaagaacaaaatagcataatttaatgaacggtgaataaagatatatcgatgttaattcaatgaacgtttagataagaatatgtctttaatgaattaattaaaactgggagggtgcagtggttggatttttggggtctatagcaatacctgacaacctaaaagctgtgtgctgctgttcagttggtgtccgaatggcttttgcttcaacacacaaaaaaaaagtaaatatttctttgctctcgattgatctcaattaaaaatttaagtttttttcaccttacttttttattcttgattggaacttagtataaaaataaaaatgagtcattgaaattaaaatcttgataaaatgaaaggtattgtaaaaacagtaacatggaaggaagtaaaaagttacttaaaaaaaaatctggaatcaggaaaaacatttttttcttcttgtatttgagaaatgaggaagtaggagctttggtaaatgtggaaatcttatcttaagcacacttcaggaatacaaagtggacaaagaaaatgcagagagtgatggatcaatggtcagtcttcatggtaaaagcacccatgacaggtctataattttgtaaaacactcactttaaaaattaattttgtaaaataattcattttggtaaaaaaaaatcctcatcagcacttcttttattcatcatcatcacattcaacaggttttttcagctttttttactcaatataaatctagctagctatctcaattttatgtaaatagtacaaagtaaaaatcagttacacaaatactgtaagttgataacttattaggggtatgaatgtgttaaaacttaaaagcaactttatacaagtggtcgagttgaaaattaaagacagtaacacatattcgccaattaagctagtttaggtctttgatcgacttgtcttttggaagattcattgtgtggaatgctgtactgaacacgttcatttccataactgaacatgcatatgtatatattttcatttgttttgaaattatatttttaataaaataaatttttgtaagagctctttattttcgatttagtgaaaaatttcacaaatttagataaacttattatagcgtaccaattaaaattatagtgaaaatattaataataaaaaagctactttgaaggggggaattagtatattttgttcttgtttactatattttgattaataactttaataatggtgttgcgattatattttaactaagctaagataacaaagttaaattacatttttgggaaatattaaatatttaaaattttattttatgaaaatttagaaaatattttaatgtgtgtgaaaataattagttagatgattaaattaagacaaatattggtgaaggaactaaaaataatttttaattaaaatacataaagttgtgttattattcataatttttttcttgtgctgtactataaattttataataaacatttctattttcttttttaaatttcttaactaataactaacaattctcttaaattaaataactaggtggaggcgtggagcgcatgttgctaaaagctgtattttaattagggttcgatggtatccgacggttgacagcgtttgagcattcttaatcgctagattaagctgagtggggagcttcaatttaatactcttgtagtatattatatatatgcttcttcaccaaccgttttttatcttctgaataaataaaacaaacgttttgtctcttttatcagccttgctcaaaattctattccttcttcatttccctcgaaaatccaaggtatgtttgttggaagttaggcctcattatattgtatgttgtttgaaatttgggattattggggaatgaactattctgattaatgttttgtttgatggttgttccgtcatcttgctttggcattgtgttgcgtactcggcaagtgcaccgatcatacaagtaataaaatgataagtcagatatcgttcccatgaggattagtgcaccgattcgattataacttaaatctaaaagttggatgaacaaatgttttgtaaatgtgttgattgtttgttcgaacaaataaagtaaagcgatgtttgtaagcataaactaagtataaacaagaaaataagttttcacaatgtaaacgaagcgtagccagggcacttacattcgatgttcctcccaaatggttcgtattgcatacttatattcgattagttaggctatttagcacatatgtgtatctaaattcagttgtttaccgattcctcagtgacacaaccctttaacccacttaaaagttctaattccttagtcaccttcctagggttaagcattaagtaacataatgaataagctacccacatacattcccattcctaggtaatgtaaagcaagctaccacacttagttccaagactaaagccccaatattcctattgtgaaccctaactctaaaacccttaatagattgatcaagtctaagaaagaggtatgaacattcaagcaaagtgtagtaaaatagctttcaataaatgaataatagcattcaatacaacccaaatgagatttacatcaagtgcttggccctagctacaaaatagaactagccaaacctattcatggctggccttggtacatcaaaaagaagcatgcccagctgatacacaagcaaggagaaggaggagaagaaggagaagaacccacttgacctcacaatccccaaaccctagctaggcttccaagctttctttcttccctttcctttggtgatttttttcgtcaaaaagtcccttcttcagaggtgaattactgcttttatacttggggtaaggaaatcccaagtttacccttgacaatctgcaacatttaagtgtggcgcgaaccgcgtggcaattggcgcgaacagcgctggacagtggcgcggatggcgcgaccatggcgctggtagcgctggctgcaactggatttcccattttgaagatggcgcggatggcgccatactccacgcggttagcgccagattccagaggaacttcactttccagggaggttctggcgctgatagcgctgacattggcgctggccgcgccaagttccagaggaacttggatttccagagcagtatccgcgcggttagcgcggataatggcgctgatcgcgccagatcttggcttttgcttcctcggaagtttctttggctcttttcacctgttgactgtttaaaactgatcaaaaccacatcaaagcgcttttagtcaacattcatgcaatttataggcttttatcgttcattctcatgcattttatgatctaaatatgcttggaaagtacttatgctaggcgcatatcaaacaattcccagatttattcattgctgtcctcagcaataacaaagatcttgaacaaagaagtatggaaggaatattcaatcatagcatcaaactaacaatcatggaattcaaaattgttcacacaactgaatttttatcttgaacttcaacaatgcttttcagatctatcataacaaagtctagcttgaatacccttaccaaggacaaaatcactcagcactcaagtgtctagggtataaccaacatatctctcagtctcaaaaatgataacactaccataagcttgatcatattctccatttccatacagaaatttaacacatgcatgcttgatcaaaaggactttcaaggttgtaacttggcttggcttaagggtggaaaatttggaaagtgactaaataacattgagattggaatagcacaaaaattttcattcattcaagcttcacttctacattttcattccactacaattttttttttcattttcatttgttctttgtttttccttcatttgtcttttctctttttttttttctttttctttttctcatgaagatcctttttcttaatttcctttgatgttcaacaaaatttcacttgaattctttttctttttcatttctaaccatttacattccaatctcaattaaggtaagataatgacaatggtttaaatctttatcagtgaatgaacaatcaggttttaagctcaaaggggctagcaaaggatcattttaaaggaaggctatttagctcaagcttaagaataaaatgccttcatcacatcaattatgcatgcatcattgagaaacaaaccaagttctagagtgttaccacagtgagattctctaaaaaaaaaattatctgtgtaagcacaattctcaccggttatcgtatcaagctagattcatcgatttcaaatcaaacatcatctctgttctaacaattacttcagtcatgcaacaattccagattccaatcatgctcattcaatgtaatgctcaaaagttcttctcacacaagcttctctattctcaatcaagttttcactgagttggcatttctaactctggggcatgctttcacaaaaagtgtctaatatgtactcctacaaaaagaattatccacaaaaagaatttctgactccaaaaagaatttcccaaaaagaatcttagacatcctttgttctcaaaatatgattcactcatttcctcaattaacgcgtaccccaattcccaaatttatcattggctgtccccagtgaataattaacccacgggtcttgaaacaaaaacaaaataagtaggcgttatttgaggacacaaagacataggaacatcagcctattaatttcccaaaatatgtaccaagttcaatgcaacacaagttcaatcacaaccacgtaacacagttcaacatcaaaagcaaacacaatgataagtctgaattgtaaaaacagaaataaaaacagaaacgaagaaatgtgaagttcattcagtggtgatcaatcctcctctatgggctcatcagcaggggctgaaggagaggctggaggatctgctgctgccggcggtgatggataagcaaatgcaagcgctggaggctgcagctggtactcggaaggatcgatggcaaggcggcggcatatggcctcaagcatgcgcattaagtctctaacaggacttgctgactgtcctgcttctcatgtagctgtagatagctaggagagtccttataaatatgctcccgatgcgctgcctgaccagtagaggaagtgggtgcctgacgaggggaagaaggagctgtctgaggatgtagagactgagctggctgctcgggaatggggagctcatcatggttaggagccacctcgcgaggactcctaacatctctatcctctggagccatggcggtagctctcaacagttgctccttcaccgcattcttccgagagtccatgtaagtcttcggagtcatcagtgtagcgataggaacgtctttgggctcattacccggaatgacgactccggcacgcctgcagaggtgtgaaatgagcgaagaatgtgccagcagagagcgactgttgccatcccatatcatatggagaattctgtcagaaagggtcctggaaatgttgaggttcatgtccctcagaagtgtaaacagcagtgctgccctctctatattcacatcagtaagattagttgaaggcagcactgtgtggttaatgaattgatgccagaactcagcatctcctatgaggtcttgcctcctcatcttctcgggtacccaatcagtgccggtcttggtcttccacgaggtgtatagtcctgtgataccatgcctcagttcatcagccaactgaggcatgtcatctctgtagacactcttcccagtcccagggataggctgcatgcggttatagaaaaccgcaaactgacattgctcattcagtacatgggatgtctccaggaaatcttcaatggcatagtagtcaaagggaactcgaacgcctctgacccaactgaccctctgatcatccacagtgtctcggtctacattggccaagaactccttaagaatagcgctggagcttagctcggcaaaagtcaccaaggtctgcactgcctgcggatgattaattgtcggactggcgagtcttcagggaaggattcccaactgatgcgcttctcaggtattatctttttcgggaggtaccacttatcaaagcggtcttgggcctcctgggatctgaatctgtcttcatcataccctgagatgcgggggcgtttaccagcagcggaggtagaacctttctttttcttcccttggtcaacttgtttaccctgaaattcaagaaaccaggtccaatgcaccaagatattcaacaatttgatcaaacaatttatagccctgtccttgaaccaatgcaattcccagatttaaacacaattatatcaaggacaattagcaataagtgtggcatttatggttcatgaaacattaacaagcagtggaagtcaagatgatgaaagtccttgcaccaaagagacacaacattcaacgtaagatacaataacatgagtcctcactgtcaactctctatgtgcttagtacaaatagaacaacaatacataaccttcccctagccttgattcctagatttaagacaatgcacatccctgtttaattatttgcaatagcaacatgcatcatttcaaagcaatttggaacagagagcatcataatcatgagtaattcatggccatttagacaatacatgacaatgtgagcacaaaatcgatccaagtagttgggtttgtgcaagtctagagctacaaatttatcaataagggttagactgagattcaaggtcctacactggcccagaacatgggaaacataaacaaataagcacaagaaatcatagcaatccattccagactatgtcaaaccagtcattaaccaaagcaacaatcattgaaccctctaacagcatgcaattcccttccccattcagtcatctagcctagggtttcaattccaagtattaatcaacaaagcacaaattaaaaccctagatgcagagtgcaaggtacaaaagggtcaaccatgtaagcatcctcaacattcaaaggcagttaatcaccaaaaacagaaataacccagccagcgcgaattgcgccataactcacgcgatccgcgcgagctgggttcatgccctaaaccagttgcagaaaaagggggggttttccacagaacccaaaatgcaacaccctaaccacccattttaaccctcattcaagtgaaaatatgcaagaaaactcaccttgtcaccagccattgagattgaaagcaaaaaggaagcaagaatggagtctcgagcttgatggagaagaggatttgaatgaaatggaaggaagaaaatggggaagggttcgttatggagtgaatgcggttaataggagttaatgggagttaaaaaggggtttatgcaattgagagaaactgaactggaggttaatggatgtttggaaggtgagggggcacgagggagttctgatattttaaattaaaaagctgttcgaaaactcccgcgcggatcgcgccccatctcacgctgatcacgttacactcatggacatggcgctgatagcgcctctggcggcgctggccgcgccaacttccagagaaaatggcattttgaaaatagtacccgcgctggtcgcgctgcaagtggcgctgttcgcgccacgaataagatggaaacccaggtggcaccaggagcaccagatctcgcgctggccacgccacattccagagggaattgtaattggagagcacttgtggcgctgaccgcgcggctaatggcgctggtcgcgccacatcaacctcatgaatcccaactggcgctgatggcgccagacttggcgcgatccgcgccatggatcaaaacaagagtaaaatggccaaattcaaacagaactgaatgaaaacacctatattgagctaaactacctagctatcaacaaataacaacctaattgcccaaaaagtgattgagttgcctctcaataagtgtttgtttaacgtcacgagcctgacggaacaccctttaagaatcaagggtgcttaaaggaatagaaacagtatccctaacaacttggccaccatggaaaggtttcagcctccagccattgaccttaaaaggtctctcaacatcaagtggacagatttccactgttccataaggaaacactctccgaatgacataaggaccagaccatcgggatttaagtttccctggaaacaacctcaatctagaattgtacaatagcacttgttgtccaggttcaaattcctttggtctaatctttttgtcatgccaccttttggtcttttccttgtaaagttttgcactctcataagctgcaagtctaaactcatcgagttcattcagttgcaataaacgcttttcaccagcttttgagagttcaaagttaaggaatttggtggcccacatggccttgtgttctaattcaactgggagatggcaagacttaccgtacaccagctgaaatggtgacataccaatcggggttttgaaggcggttctgtaagcccataatgcatcgtccaatttcttggaccaatccttcctggagttcccaacggtcttttccaatatcctctttagctctctgttggagacctccacttgaccactggtttgcggatgatatggagtagctaccttatgggtgaccccatacttggtaagcaagctttccatttgcttgttacaaaaatgagtgccaccatcgctgattatagctctaggaactccgaagcgggtgaaaatgttcttcctcagaaagtttgctacgacccttgcatcattagtgggtaatgccactgcttctacccactttgagacataatccacagccactaaaatgtattggttggaatatgacttgggaaagggtcccatgaagtcaatcccccaaacatcaaatagctcaacctctagaatgttgttgagtggcatttcgtctttccgggatatgttacccgtcctttggcatctgtcacattgttccacaaattccttggcatccttgaagattgtgggccaatagtaaccactctgtaagactttgtgagcggttatgttacccccgaagtgtccaccatagcttgaagcatggcaatgccacagaatttttggaacctcaaattcagcaatgcaccgtctaatcattccatcagcacattgatagtacaagaagggattgtcccattggtatcttcgagcatcatggaagaatttcttcctttgttgccatgtcaaatcctcaggaatcactccagccgctttaaagtttgccatgcccgcgaaccacggtccactagccactgacatcaattgctcatcagggaatgcatcattgatcatcaaatcggggctgtcttgcaacgttttctcttggattctggacaaatggtctgccactttgttctccacccccgacttgtctttaatttccaaatcgaactcctgaaataagagcatccaccgcaacaaacggggcttggcatcctgcttagtcaacaaatacttaagggtcgcatggtcagtgaaaacaataactttagatccaatcaagtaaggcctaaacttatccaatgcatatactaccgctaacatttctttttctgtggtagcatagtttacttgtgcctcatttagaattttgctagcatagtaaatcacatgcaaaagtttatccttacgttgacccaaaacagctcctatagcataagcactagcatcacacattaattcaaatggtaaactccaatcaggtgcagttaaaacaggtgcagtggtaagcttttctttcaaaacattaaaggcattcaaacaatgattatcaaagttaaactcagaatccttgaccaacaattggctgagaggcttagctattttggaaaagtctttaatgaatcgcctatagaaccccgcatggcctaagaaacttcgaacaccattaacatttgcagggggaggcaatttttcaatcaacaatagtttagcctcatcaacttcaatccctttagaagagattttgtggcctaagacaatgccatctctcaccataaaatggcatttctcccaattgagaactagattaatctcttgacacctctttaatactttagacaaattaaacaaacaggcatcgaaactagaaccaaacacagagaaatcatccataaacacctctagaaatttttctaccatgtcagagaaaatagaaagcatacacctttggaatgtagctggcgcattgcagaggccaaaaggcatccttctgtacgcaaagactccaaagggacaagtgaatgcggtcttctcttggtcctcaggtgctacaggaatctgattgtaaccggaatatccatccaagaaacagtagtaatcatgcccggccaatctttccaacatttggtcaatgaacgggagggggaagtgatccttcctggtagcatcattaagccgtcggtagtccacacacatccgccacccagtgatggtccgggtagggatcaaatcattattctcgttctggaccaccgtcactccccctttcttgggcactgtttgtaccgggctcacccaagcggagtcagagataggataaatcatgcctgcatcaagaagcttcacaacttcttttctgactacttccttcatgatggggttgagccttctttgcggttgcctcaccggcttgacatcatcttccattaggattttgtgagtgcaaaaggaagggttgatgcctttcaaatcagaaattgaccacccaatggcggtcttgtgctctctcaacaccttcaacaacttgctttcttcatcttttgatagcccattgttgatgatcactggataggtttcttcatcccccaagaagacgtatttcagagactttggcaactctttcaagtctacttttggtgcaccaataacgatatcagttgccttcttctcaagaatttccagagccacttccaccacttcttgtggaatgcacacattcatccaagacgtcaatcctgaagcaatcatttctgtcaaatggattcttcatcatgtcaaagacattaaagactactgactcatcattcatcctcaactccagtttgcctttttcaacatctatcaaggctcgggctgtagctaggaagggtctacccaacaaaagtggtatctcactctcctctgccatatcaagaataatgaagtctgctagaaatatgaacttgtctaccttgacaagtacatcttccaagactccacttggcttccttaaagacctgtcagctaattggagggataccatggtaggcttcaactcagaaatgcccaaagacttgcacattgtcaatggcattaagttaatactagcaccaaggtcacacaaagctctaccaacgttaatattcccaatagcaataggaatattaaagcttccagggtcacgaagctttggaggcatcttcctctgaatgatggcgctacattcctctgtcagaaccacagtgtcacattcttgtagcttatgcttcttagacaatatctccttcatgaacttagcataatttggcatatttgccaaagcctctgcaaaaggaatattcacttgtagcttcttgaacatgtcaaggaatttagcaaactgctgcttttgtgctttctgcttcaacttcaagggataaggtggcttctcaaatctggaaaaatccagaggttgtttgggaactgagggaaccttctcctcctctttttctttatcttttggaccactggaagcttccactacctctggttcttcagccactatggaagtttcttttccatcatcccttgggaccactttagatttttctttaggagtgatcacaatctcactccttgtagtgatggcctttgcatgttctctaggattcacaacagtgtcactagggaattggccttgtggtctctctgctagttgtcttgaaagctggccaatttgaacctccaagttcctgatggatgcatcttggtttttatgatgagcccttgtctcattcatgaatgcatcagtggcttggatgtggtcattggtagtcctggccagttgcaacatagccttctctagttcagatggttccttgggaggaatggatggaggttgcaagtaatggttagacttgtagtctaaaccacttgcttgaactcttctctgaaaattactccctgaagcttggttgggattcctctggtaatgtggttgcctttgatcataccacactccgttgacttgaataggatctgctcctattaaggtggggcattcatttgactcatgatccccttggcaatattcacaaacaaccccacttgccttgattgaagaagcatgagcttttgcaatgtcaagcttatcaatcttggcattcaagatggctagttgttgtgataataatttttgttcagccaacatcgcatcactgctgcccaaatgaatgacttctcttttggctttagctacaatactctcgttttcattcctagctagagaatcaatcaattcaaaggtctgggtagctgtcttcgaccttatagaacctccggctgcaccattaaccactaatctggactcaggtagcattccattgaagaaaatgcgcaccttcttgcccattgtcatgtcatactgagggcatcgcctgatgagctcttggaatctattccaagctgcgcacaatgtctctccttcttgttgagtaaagttggtgatttcgttcaccaagcgattgtatttctccatggaaaaatattgtgcgaagaacttggccatcaattcctcccaagtggtaatactgttggatgcttgttgatctaaccacctgagggcttttcctttcaaggcaaaaggaaatagccgtagtcgaatggcatcatctgatacaccttggtgccgcatggtgtcacaaattcgaagaaatctatctgcaaagtcatgaggatcttcgttgtcctcaccaccaaactgactcctttccaccaaaccaatcagagaagggtggatgtcaaagttgttggcttgaataggtggcctgacgatgctagatgtaggcctggtgaacaatggagctagaatctcctccattaattcatcctctggcctaggcggagcattctctctttccgccatatctagttcctccacacgctgtgaactagatgcctctgcttctcttctttctctggcaagtctcctgttcctccttgcagttctttctaattctggatcaaactgaaggttcccaggatcaactgtacctcgcataaactcaagaagcaggtaagtaacaaaagaattccaatcttaaagatagaaagttatgataaaattggcgaaactaatccccagcaacggcgccaaaaacttgttgcgtactcggcaagtgcaccgatcatacaagtaataaaatgataagtcagatatcgttcccatgaggattagtgcaccgattcgattataacttaaatctaaaagttggatgaacaaatgttttgtaaatgtgttgattgtttgttcgaacaaataaagtaaagcgatgtttgtaagcataaactaagtataaacaagaaaataagttttcacaatgtaaacgaagcgtagccagggcactcacattcgatgttcctcccaaatggttcgtattgcatacttatattcgattagttaggctatttagcacatatgtgtatctaaattcagttgtttaccgattcctcagtgacacaaccctttaacccacttaaaagttctaattccttagtcaccttcctagggttaagcattaagtaacataatgaataagctacccacatacattcccattcctaggtaatgtaaagcaagctaccacacttagttccaagactaaagccccaatattcctattgtgaaccctaactctaaaacccttaatagattgatcaagtctaagaaagaggtatgaacattcaagcaaagtgtagtaaaatagctttcaataaatgaataatagcattcaatacaacgcaaatgagatttacatcaagtgcttggccctagctacaaaatagaactagccaaacctattcatggttggccttggtacatcaaaaagaagcatgcccagctgatacacaagcaaggagaaggaggagaagaaggagaagaacccacttgacctcacaatccccaaaccctagctaggcttccaagctttctttcttccctttcctttggtgatttttttcgtcaaaaagtcccttcttcagaggtgaattactgcttttatacttggggtagggaaatcccaagtttacccttgacaatctgcaacatttaagtgtggcacgaaccgcgtggcaattggcgcgaacagcgctggacagtggcgcggatggcgcgaccatggcgctggtagcgcgggctgcaactggatttcccattttgaagatggcgtggatggcgccatactccacgcggttagcgccagattccagaggaacttcactttccagggaggttctggcgctgatagcgctgacattggcgctggccgcgccaagttccagaggaacttggatttccagagcagtatccgcgcggttagcgcggagaatggcgcggatcgcgccagatcttggcttttgcttcctctgaagtttctttggctcttttcacctgtggactgtttaaaactgatcaaaaccacatcaaagcgcttttagtcaacattcatgcaatttatagacttttatcgttcattctcatgcattttatgatctaaatatgcttggaaagtacttatgctaggcgcatatcacattgctattggattaaattttctgctcttgtttgttctgtgggctgtggtcaatgatgcatgtttcatcactgtttcggaaggaaatcgtataatgaacaatttgtatgcgcccttatatatgctttaaagtaaacttttcttaaatgcagattttttcagcctaattagaggtttggagtttgaattcctgatatatgcaattgcattatataatctattgagagagaaatttatccgatttgatcaggattgtctggagcaggtgaacaaatggcagagcatagagaaaataaggttgttgataaatctcaggtagctccagctacaagtagaaccatgtcatttcctctatcattccttgacttgccttatgcacgtcctatttatgtgaaacgcctattcttctatcactttccccatcccacacacattttctatgaaactatactcccttctctcaaacacaacctctctcttacccttcagcatttcttccctctcgctgggaatctcctgtgtccaccacaacctcacaaacccttcattcgctgcaccgatgatgactctgtcaccttaaccatcgtcgagtccaaagcatatttcaaccatctctcatccaaccaccccaaaaaatctcaaagatttggatcacttagttcccatgttgacattcacaaccgtgcatggtgatgatgaggaggaggacacgtatgtttccccattggtggccttgcaagtcacggttttccccaaccatggcctttgcatcgccataacaaattctcacgtgatcatggatggcaggagtagttgttatttcatcaagtattggtcaagcatttgtagaagtggtggagttgacttgacacccccttgctttgatagggaagtgttgaaggacaccaagggacttgaggccatcttcttaagagactactttgaagagagatcaacttggaaggacaaactcaaactcattggtcaaactcctaatcatgatgaggactatgttaaggcaacagtttcctttggaagagatgatattgagggaatgaaaagatgggtgctgaatcagttggaaaaaaatgatgaattgatgaaagcacccgaatatctatcaaagttcgtggttacatatggtttcatgtgggctagctgggttaaagcaaaatgtagacatgatgataataatgatgaagatgaacaagagatcatgaaagaggagtactttcgttttgcagcagattgtagagaccgctttgagtatccaataccagcaacatactttggaaattgcttaacaagatgtcatgcattgctcaagagaaaggagctaaagggagaagctggttttgtgaaggcagtgaagggcattgcaagggcaataactgatatgaaagctgaacctcttaaagatgcagaaaactggaaggaattaagtaggaagatgtttgtattgggaagtacaatgctagttggagggtcacctaaatttgatgtttatgagactgactttggatttggaaaacctaccaaagtggagatgatggtacatccccaaatattgtgtgtgtctcttgccgaaagtggagacggagaaggagggatagagtttggcttggaatttacaagtattggggaatttgagtattttagttccgtcattgagcaaggacttgtaacattaaaatcctaaatgattgcatcattgcatgtggtccttgttaatttccttttctgctctcattaattcacagtcactctgtaatgtaaaaacaatatggagtattactactttttcattaaagttggaataaatatatcttttttttcatctcattttgagcctaaatcggacactatcagagttattttttagtcgaggttgatcataattattttgtctgaagttggctgaagcaatttttttttttgcaaaagtttattaggattttttccagcagatattgattagggttatttttttagctatttcatctaaaaattttcgatcgacattcgtggagattgttttttgttaatattgactgaagttggttaagattattttttggccaacattaacataggttatttttttgccaactttaactaaattttttgaccatcgttatctaatgatgttttttagtcaacatcgatcaaggttgttttttggctaacatcttctaggattttcttttattgatattgatcaaagctatcttattgctaatattggctaggattttttcagccaacgtcaacaaaacttttttttaggcaaaagctatcttgtagagtgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatactccctcttatctcaaatataagaaaaatactcttttcttggtttcaaatataaaaaaaaaaaatcaattaattttccattagttaatgttagtatctctaaaatatcctttatttaattgaggtattaattttagtgatttttctctgttttagatatcaagttccaataaaaattaaattaaaaaatatttattaaaattagtataattaaatataattaactaattttattcattcttacctcatctctttacttcaaatcatgtgatcccttgaattaacagtttgatgataaataaaatgagttaaatgtgttttagtaaaagaaaaaaattaatgggtgtgaataagttttttcttcttatatgaaggggtaaaatgtttattatgaattaaatgggaagaaggcaagttggtaattttgaaattgcgtgaagggctgtgttgtccaaaacgcctcaaatatataaacgatatgaccgtagcgggcttccacgaaaaattcaaaatccaacgaacggtaacgttttcggtcttcttcttcttttccttccgcatctcgttatcattcatcttcggtgttctctactcgcggtctttacttttaacctttctgcgatttcgggtatgttatattgcttctgtttgctttttgttatatttctgaattctatttatttaatgtttttgaattaggatttatgttctttaaagttagtgtacttgattgattgatacgtggaattgggaaatatatgagtaaacggcactttcctagaaaccttatgggattttgctatggaaaagaaaatattagcactagcaaaggtttttcttcctcgtgatgttcataaccttttttttttttggtttttgttttttattcagactaattttttaatttgttttgcagagtccagtatcaaagtctttgctctctgaaaaaagtgaaataggataatggctaagtttgttgctcctggccacctgattatcaaagatgaaaacttgaatcttcattctaaaagtaagtatttttaatttttatgttatgttgcttataacaccaatttccaactactatagttgattcattatgaattagcaatgaaaaagttttcaaagtttagaaattgactttgcattctgtaacagtattggtggttactgcactcttctcttactgtgttagttttgtttgccctttgtgtttgctcgggacagagactactaagtcgaagaattctaagacaaatggaaaaaaagatggttcagggattgcaggtcgaaaagctctaaatgatataacaaacaaaagttcacttcaccaccctgaagcctcggttaagaaaagaaatttacccaaggaagatattaatgtaaaggaggaaatgttcttgcatgatcacaagaagtgcattgaggctcaaaatgctactatgagaaatttcaatcttgagaaagttcttccacaagatggtatggcttttacttcagtattcgatgtatggcatgagttgtgaaaatctttatggtgcaattaaatcagtttcttagtttaccaaaagattgttaccttataattttgacatcaattaaatcaatgtcgtagtttttaactttacagttacaacttacaagtaaaatgtggtattgaatattatgatgagattgtgcatgtgatatattggcatgtgagtgagttcttgagtaacttatttctagcaatctttattagaatacaatgaagagagaattgacatttggcattgaagttggtattagtaacttttgacaaaaaggatttcttgtgagatgatttgatttaaaatatatctgaacatattcctattcaatgttttggtgaattaaatttggatgtccctgactatcatgttgatggttattattattagataatgttgataaaattcctaacaacattttatctctgcagattccatatctatcctagagctgataaaggtaatgatgtatctttctgaccccttttttagtttgttttggttacatgtatttgaagctgaggggtgctttgaggacaaccactgaatatgtactatttcattttgtcatatacaatgaaaataacatgctttaagatgatttaaatcttgattaaagcatttaataatcaatccactacaagctgatatcaatttttaagcattttgttgattagaaactttttactgttgcttcccctttgtctaacatttgctttatcttctgttttcctttttcttgtggcgttaggttcctgattcccctcaatgctacccagaaccagttgaattgccaatgtccaaattttcagattggtttgaccattcaatgcattggagctcccctccatcttctccgttgtcatgggactctccagcatctccccttgcatggcaaaatgaagcagttgaatttgttttgaaggaagaaattgctgtccaagtgtaacctactatttcttttgtcgtgtaacagaacaagtgaatcccaccgttgattgagcctcgttttttggtttctttctctgtatcgcttcataatcctagtcccttcagttgaatgaatttctagtttttgtcaaaattaaacatcagatctagtgcacgagcaatgtggaacaggtaatgtagtcatgagttagtgcatcttatgcattaaacttgcagtgctaaagaaaagaccaaaaaaatggtagcaattccaattgtattctgtctaataagacattttctgaagcctggtaactgcatatcaaataatcagtataccatgatatatgctgattatttcataattcaccaaaaaaaatcagtaaattagaatgctgcaaaatatattatttgggaggattgctgagagtagaacactatcaaggaagaaaaggaagttaaaagaaattgttcaagaaatgagaaaaacaagcaagtgtctagtggattccttagtaatacaatctgtcaatctccaattatataaatttgacatgtggtttaatggtctaatgtcgatactagttcttgttacgtaattaccttgtctttaagtgctgaattgaaaaccaagaatgctatggccaaacaaaattcataggaaacatcaatgtcagatgatgtatgcaagatagctttcaaactagccgatggaaaattcaacaattaatactttaaaaaattattacttcagaatcaaataattagtatttatgatagggaaactcactgcaagagactcttgtacagttgtactgaggttttgaaaggaaaaatgtacgtgatcttgttttcacatgctaatggttcaaatattgttacatgatttttaattcgagtaaaaaagaatgctgcggattaagagtggaattagcataaacttgagtgatgcattatcttcaggttcttcacctttgatggaaggtctctctactgaagcctcactcttcaaatcctcaagcaattgcaactcctcaaaaattgttttctgtggtttgtcttgaccgtgtacttagagggaattacacggaattttccttcatttaactactcttgtttatttagtgattcttgtgggataggattaggaagcttcaagggatttcctaaaagtgccttctttgttatggcctaccttggtcctataggggggtatttcgcctcaaacagaattgcattattttcttgattgtgccttgaaacaaccgtgaattagttctttcttggatgactatggtttgagcaatttcaagccatcatgtcaaatgataacaatcaacaagtggtaaaaattggcgtgaattgtataagttttacactcttattaatcttgaattgacgtacgtaaatctaacacaaatattagatatgataccctaacaattagaaaagtctcacggagatcagcagtgaaagataaattacccttcacttaccaattcgaattctgccaatgcaacaatttatggtcaattttaccagcccacgcgcagtcacaaatgttgactttcctaactccacctctaaggcgagtgtcctgattagcttagcttaactaaaaaatgaacattagtcgtttttgcaatgctctcattttcgttgtcaatgttgtcataggagatttccaggtgaaagcacacatagtgctagatgccaaattgttgtacatgcctcccaaatttgattcaatccagttggtataaagatttagttctaatctatataaatatttcaatcctcacatatatgttttaatttcgttcgtagtctttcttgttgaatgcgtaaaatcttcaacaatgattggatcgaacttgaaattattgatacattattattcaaggttagacgcagtgcagcacggcttaaataacatatctcaaagagagtagcgtaattggattgctttataagaaatgtgggggaggggggagggttattgatagagataaaaacattaaaggaagtaaattacagaaatgacaaaaatacaggggtatatttttttttttaacatgaagacacacaatatatcatctctcatctagacatcatctccaccgctttgtccacattattgttcacgccctccttttcataaaagcagtaagatgcagcaaaatcacagtattatagatgtttgcctcttacataccagatcatgtgagtttgatagaaaggattctgttacttttttctagacacagctgctgcaatcccacctgctataagtcctacagcagttgcagcaatgcctaggccaatgacaccatctacaatgaaagaaaagcagcagtcagtgcttatcctcttgctcttggtaagaaaaaaggagcagagaaaaatgttagtggaaaatcaagaattgatgggaacctttggtgatcttatcctcgattgtcgtcttgagtgtcactgcctgcctccagtcgggtgcaatctaaggaagaaaacattgacatgatatcacattaaagtacatagatgctgcattggtgcatatgcaatagatcaaaatttaaaataaaaaatgctgtgctttgcccttgcttggaatttgttgttgggtttggagagggatatcacaaaaaaaccccaaaacttatagatactgaatctataactttttcctctataacaaagaaacaacgcatcaaagacttaagtatatgaaaaggaaaagaggagtaaaaaagacttgagtatatgattctagtgaaccaatgtctacattcaacaaccagtgtctaagtgttcaagatggttaactcaatttcaaatcgtgtggagacatcaggtaagagatgtcccaacagacgatgtattatattcctttctgtcaacgcattgttacagtaaaataagtacaggcttcagagaatgcatacagaagtcagattctattccaaaacatgtttttgaatgcaagatacagatgacaactagctacacattgaaactatattagcaaatatagttcgggcattatgctagagagtagagacacaacacaaacacaacctccttctccttcaggtccaaaacatacacctctgccacactgattaggggaaatcaatagcagaaaacacaaggttgtgatactttttttccacaaaaagaaaaggcaaaatcattatgctgtataattaggatttgtctcctctaaagtaagtcccgattaaaggataaagtaagcaatcttagtcatcgatgagaaactcattggtcgatactgcatggacatgttacatgtataagaaaatctaaatgtgactaaatatcacgattgagattccttagagagatggatacataccgcgaggcacctgtcgacgagatccctactccttgaataatcagaatttctatagtatccaacagccagaagataaagcttctccctttgctgcaatgggtcctttgtggcaggcaaagatgctgccatttccatgtaattaatgtcttttaactatcgattaacatacatacatacataattgaattgcatgatgaaagagtaaaagagagagagagagagagagagaccttcaagcatggctatcccacggtgcacatcttgtgggtgtttggagtgaacaagagcccatgataaacgcaggagacagtcttgcatatactcttcagatgattgtttttctgcctccaacacctctctttcacatccctgccagtgcagtgccacacacaagaacaattaattaatcaattgcaatctcaaacacttaaaaacatacataattgataagaaatagattgaatagagaaattttgagattgacaaccctagcagagaaagagcatatgaatatgaaacatacagcgacgacgtcagagtcacaataaggaaggtggtctttgccggagaagaactgacccactgagtccacgatcatccctagcttcgcttcaagtttcgccatttctacacacaccgagttcaaccgagtttccagtgagttgactttgcttcaccaactcgctccctctcttcagattaattgccgcggacaccgcctcctaagtactaaacccccataaatataacattttcttttctgcaattattatttattagtcgctgatggtgtaataaatactttttttttcttactgtatttcttgtgatctggtcataaacttgtgtaatgcaaaattatgtcgcgttttgaaaacttcagaattaagtcatttcgtaatatcttgtgacaggcaaacgaagataggtctggtgggggcagaaaacaatcctcttgctaaaaattgacacttcttcgaagttcgttgcattttatattttaattgtttctatgatatttgcaaccgatataaaacttacatacattttttagttcttataatttagtaatttttattatttgttattttaaagttattttttttattagatgtcaaaattaggtcttttcattgttaccagttatcccttagcttacttatttgacagacaaaatctaactaatcaaatatgtggaaaatattttacatatcataatatcttaaaaaatgtccatattagaatttacatgttttaatatatgaaatttcgtattatttaaaataaaaatattttgatatctgaaatgcttttcgtgttattgattagttataaaccatcctatcaattaagtagatgatgactaatgtcaacaaatgttaaattttgaatgtcaaaccaacaaagagacccaatttcaaaattcagtgtatgggaattaaaattgcatcaaaataagagcactagaatttaggatcccatcctagtttcttacatgcatttcttccctttatatttgtgttttctcaaaacattgttattaacacaaattgagacaaggacgaaagagacagctagggaaattgcgaggtgccttgctaacattaagagtacacttctgaggtgaggttcacttcttggcttcattaaagtagttgatacttacaaggccccacccccacaatggttagttcataatatatgtttacttgagcataacgcataatcatacaaataatgttgagagcttcacaaacagagtgtattaatgtaagaatgagaacatatttcttattcatagcaaactagcaattttgagagaagtctcttagcttcctgtacatatctaattacttacaaactacaaatgaatcctctatgccaagccaaattgacaaagaaaacaaataaataaaattgaaaaaacaaagcaaaatcaccatgcatatggattttcacaaactaataatctctatcccccactcacttcttttctggttcatgtaaagagagcctcagaaatacaactaatctcaatctcataactatttggagcatattagctacttttgacaagtgaacacgctgtacattatgtaccctgcaaagcattggttccagaaccgtcttgcaaagtcaaaactaaaatctctgaggacaaattcctaagatgctcaagataaaagaatggcttcacaaatctcccatcattctatggtttcattggtacctacagctgcatgatgtagtataatctgaagggcatctcattcagattctcgagggaagggttctccttcccactacaattaaatgaattaagatctttaaccatctaatacaactcttgccttcttgagcacatattactctcgggagaaccattttcatcatcttgcttaagtaatgagtccccatttccggtaaaaagtcgggcagatagcgtagccgatgaagaagcactgcctgcaattgtttcaacacatgcaaatatgaaagaatatcaattatggttccatacattcatctggatagtcagtggcggcagaattaagtgctatgatcaaatttatcacacctctaaaagaagagcttctctcaaagtccttagttgcatgcaacattattgttccagagagtacaacaatgaagccacatatttctgacacaatagttccaccactttggccatcccaatcctgcaagcattatttttaaatgtaaataggttcttgtaccattcgtagacaacagaaacatcttatgcatttagcattaaatgccaaaactagttgatcataccttaaacattattacactggctagtattgtaagtgttgtgaacatgacatagtatataggagatacaattgctgtgttgaaggtgtcaagagcctgaaatattacaatcatgtcagtgaagaataagtgatccaaaatttcatatataagaactttgtatacaatgcacagagaaaatctcaattctctagaattgatttctttttccattgaatataactcagacatcattttgaacaagacttgataaagaataataaacttcacaaaatataatggatcactatgtcattttgaggagttctcaataccactagtttggcaatatgaatgccagtattttcaacaattaaacaattctttcattttaaacatctaaaagatcaagtcattacatcaagggatagcacattcaaacagattaagaaaccaacaagagtaaagaaacagaaaagtaaccacctagccaggctaatgttcacgtgcacatgcttactaatatgcagatctcttttgtataagaatgatagagtacccaacactaaacctcagaactcagaagagattacataatactacaaaagtaaaatcatgttgtatagagaacttacaatcaattgatatcggaagacaatttctgataagattaaagattatcagtaagcaatgatatagtaccaaacaccaaacctttactagttgcatgatgtaaaacaatttacttttgttgcatcttgatttgacttttgttgtattatgtaatctcttagttctgaggtttagtgtcgggtactctatcttgagttctgggttctgagttctgaggtttgttctatcttgaatttacattccataggaattcacatgttgtaatactgtatgttgtatggaggatttaatatgcaactagtaaaatcatcggagccattactgataatcttatcagaacagtccacccatggaatgtaattcccctcctactgtctgataagattaacttaaacaaaagaaatattaaaaagaggtatgaaaagaattctagatcatttaaaaagcttagcagaatttcatttcgtaagatttttcattctgttttatattaagttgtcatcttccttaattgtatatgaagttgtagctaaacttccctgcattccaattcaaaggaatagtctggcaacaagaccgcctctatttcctcaaaacaccaaacactacaaaatgataaacaaaaaaactcatatataagtcacaaccaaacagaagcctcaaatctgagcttctttgctttgcttgattcctaatttagcaatattataatatatgccaaaggtcaaagtaaataaacttattttcctgacttttccaaaatctcaaaacttgagtctaagcccaaaaatactcctatggaattgatgcctacaacagcagccaagccttatcccattaggtattgggataattaatcaatccacgccattaagctctattcaaaactaattttactgtacaattttttagaagaataaactaatgttgttaggaaccagaatagggatggtaaaactaatgttgatactcaattagaactatatcagaggtataaacctctgttacagtgctgcaatccaagaaaatgaaaaagaaagctagggtaatagctggagactagctccttacacgatgaacaatataaaataaacaaatagcagaaattagagaacccctttcctgaggaagaactagcttcttcactcagggtagccaatattgataccaattttatcattgtccctattcgtttatcacacccatcatataatccttctcactctcctccctctatccccttgccaccagtaattttatgttattttctctctctccttcaaccacattcactgatccacatgttccactcttccccactactgcctcctgtgaagcttgtttattgtttcgccataatcactcagatccttattcatgggcgaaatttcacttccttgccactaccatacccatatagtttgtaagggagtctccttcatatatagagacattagcagttttgttgcatttttcatttttgagcctcttaggcccaatgatatcctcctcgctagtatttcttcctcctctttacaataaatctttcttttatcaccccccacgcacaaaaaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaatataaaagataaattttgcatcctatatactaacataacaacttaagaatttttcaaatgtttgaactacctaccactagtaggtcattgataaaaatatatgcacgacaagcccagtgtgctaattttaagatcatgtaacaaaccttattaagataattcatttgcatgatgacagatatagccacaactaacataaaaaaccatgtctctgggtagattaactgatttttcccttcaaaagttaatttcaaagaagttccaagggctttaacactcatcacctgcaaaattatagcaattcagtttagatcagccaccatattattgcagtgttactacaaagcaaacatttttcagtaaatatcattggttattatgacataaataattatccatgtaattggggaaagggagaaaactttatagaccatagcagtctcatataaccatacaactaaaatatatataaagaattatatggaagctgaaactttatttatgaaatgaaattcattattagaaaataggattcgacatgaaatcatgtcccttagattgtatatgttttaaacttaataactttgagtaaacaaaactttgaagtttaaatcaattatcaaacagaagacttagtaggagagataacagttaattaatttacttacagagagggaacccatcaatgaacaaatgccagtaaaaactagcacattcgtatgcccgcatcttggtgcaaaatggaagaccagaatgaaaaccaatactattactgagcccacatatgccagaaaagctgcaagcagggaggatatatttgtaatcaaggaactacaatgaattgcattcaaaaaaaaaaaaaaaaaaaaaaaaaaaaaaaaaaaaaaaaaaaaaaaaaaannnnnnnnnnnnngagtagccatattccatatttccagaacagatgtaataggttgttccttaggagcatgaataacaataatgatactaccagcaatgcacattatacagcccaaaatcccaagattgtgtagcttctctttcagaataatgtcagccaaaacagcactagaggataccatgcaaacatcattgaagaagcaaccatgttatgtcgccaatgttagaagctagcaccaccttaattctcaatcaacaatgaaaattaagggaatacctcacaataatacttaatgcaccaagaggggtaactaggactgctggagcaaacgcataagcaacaaagtttgcaacctctcctacaatcactgtacaataaaccatacagaaacagattctgcaagaaatcagataaataaaaaatgaccgataaactaaaatttgcatattttaatcaaccttcaacttcactacaactgatctaccatatgtgagtgtataataaagaaatctagcaaataataaagcatctgaaacatcaaatccaggttccactatacaatgcaaaacgaaattaattcatcctaacttatgagattcaaaaactctattaaaaataaaatccaattaattccatacaagattggataaaatcaaaaccaattatgaagacaaaataaaaccattaaggtacaagaaaatccagattctacccgaaaaaacgaaaaaataacaatactaaaagcatagaaacaaaattaaacagcacttaaagcttacttgtgatcattcccgcccaccatagtggctccaagagataataatatccaccaacacctacaagacgaccaaaaaattacaaagacatgcataccataaaacaagcttccaaatagaaattctaatagaaaaagaaaaaagagaaattccctcaccagccctgacaccagaaactgctgcagctcttctaaggccttgctttttaatgataaaacttgccccgatgaacccacttgacaccaaagctagtatgagacctttcagattctccttggacagacccatctcgaaatatcgtaactttcttctgattttggatctcttcttctccttctcttcatggatgagacacgagacaaacacggttcctcagatcattatcattgcttgtttcatgattgtggcatggaaagcaggaaaagatatagtgtgcaccaccacaaccttattattctataccacctgtgagggccccacttgttatttttaaccattttttatagtagtattagtatgctcagaatttatgcatttattgcggacattaatgaatacaatgagtttgaatcaaacatgaagtcttaatccaatcgttttttttcttttggggaacattcatgtttcaaagtttttaatgcaacctttaattgatttatctttgccctcacatgttcaattgaattcttttaacaacgttacctaattgggatattgaatatattctgtttatcttattataattgttgtaaaacaaaaataattttaaaataattattattttaattttttaatataatattaattacattttttcatttccatcccttataatattaaaattaaaatatatatatatgatcactaataaatatttgattttatatttattctttattaaaaaagaatcttcatttttcggttcgtgataaaacaaaaaatttatttttaatccttgaaactttttaaatttataataaattattaaatttcagtgtttattttttgataattttttattttttattagtctttttaaaggaactaataacaaatgaagaaatttatatggaacaaaaaaaattgttaatttatcatatactaacaaaaagtgtcaataatcaaaaataaaattattattctattagaaattcaatataaagaaaaaacaaacacaaaatttatatatttattaagaattaaaaacatattttaagttaaaactaatgatgaacaataaaatctatcaacaaattaatgatgatataagattaattttataaaattattaatctcttttatttacttattatattttttctatttgtgtaaaataacctaagacaataattataataggatagaataggaagtattttatttaatattttaattattcaatgataaatattattaataatagaatccatgatttgaaataacatatatgtcattttttaatagttataatctttcctatttaacgaaaaaagttaattagtgtagtaaaaaatacattaatttttcaaataatttttgtatctttaatttgaaatatatttttaatatttttatcttcatttctttaaacattaattaacatttatcttttggttttggttttacgtatgatttttcattacttacattagaaattagtcaacttctcaaactaaaagtaataaaaaaattcttaataatatttatatatatatatatatatataacattttatgaagaatagaagttgttttagttaaaagtaaaattcgatgtggctaatttgaaagagaaaaggataaaatctaagtatattttagatataatatttttcaattaaaatataaattttcacttcaataattaatactattgaaaattggtttaaaaaaacaagtggggaccttacaacttggtctaatataacaaggttgcggttgtacacacatcatcaaaataaaactgcctaaaataatccactaatgttatcctataaaaaattacaagttgtggcatttatttataaataaaagaacaaagttaaaaaataatacaaatagtaccgcttgttgcattttttagtgatggtgtcggaaaaactaacgtaaatatgcgtgttgacttgaacgggtgtgcagtgcatgtgcacatgaagctcccgtgtggagtggtgcaggggattgaacagagggtacacgtgttgcattactgagctggccaatagaaaatgttgaagaagcatcttatggggatatcgttccatggtagccaaatgtaacgtggggttaatattttacatcctacggatacgtgtttcgtattatgtggtggctgaggatttcttgatgttggtcttactcacatctgggcatctaacgtggcccatcgcagcccaaaaattaagaaaatatttccaaatgctccataaatgaaaatataaattatttcaattaaggggaaatgaattttaagaattaataaaattaaaaatatatatcattaacatttgatacttgatagataagaaatattaatataagaaggaaaaattaagactctatttaaagttgttacgagtttttagtttgttgtttccaagctttttgtttggataaaatgaggttgaaggagcttttaaatgaatttcaaaatcattttaactcacatttgaaaatagatttctagttttatgttcttaaaagttgtttcttccccttttaatacattctgtcactcttcacttttcattcagttttcttctcttttccttcaacttttgcatgaggtggtaaaataagttgagtcgactaatttcacatggatctggctgaagaaacctactatactttcttagcttgatcgaaacttgttttgacacaaaaaagggaaaaattacaaaccaaatttttaatgagtttggccatcattttaaaatttcaaattaatgacatttttaacccaacttgctacagaccactacccatatcgagttcaagaatcatgatcaacctaacctaaacttactcaataaaatgtaggattaaagttttaaattgtgagcacaaatttattttgatattttttagcttaatcaaaccttgttccaatttaggcttattttgaagggaaaataatattttattttatgaggaaaaatattatatacataaaaagttttactcagtcatataatcacaacttatcatatatagtaagtttgttgaattttaaaataattattttaaaataattcaaaagatgatttacgattgaatgatagtgtaaaattgtttcattatcggtgcataaacattaaactcttattttattttgaaacatcattattaaccaaaacttgaaaataacaatataattagagttgtgaatattaagggtgttcataaaccgattcaatccaaaaaattgagaaccgaataaataaataaaaaatgaaaggataaaaaattggaaaactaaaaaaatttattgaatagaatttgattttagaaaccaattcaaagtaactcatacatatgtatactcatttctatttttatttcttatataaattatcatataacttatatctatttataaaaatatatttcattaaagatatttttactaattatttgagttaagatgcataagtattatattattagttatataattacgtataaataaaatatttgatattttaaattatttttattattgattatatatcttacattttatttagtattttctataaaaaaaaaaaagttataagtaagattaaaattgaaaattcaaatctctttaaattggattggatggaattaaaagattaaactaaataaaaaggtaagatgcatgcatgaatgtgtcaaaaaaaactacttagagttctcataggaggtgtgatgctctcggtagtggcattgttccatgaagtaatgtttcagtcgtcgaagacagtgttacttgccctcttgaacgtcatagtgcttcttttctctatgcgaaactttacattaccaaccttgttgcatcgcgtgacttcttctttgtctttggtttcatgttagatttttgtcaccgatgttaactcatcaacagaaggtcgaccttgagactaacttagctcgcttcttcatagagtttttcatccttcatccttcagcatgtatcagcttacacttacttatgggctctcataggagcagtgattgtttacgttgagatggactattgttgaaatacaagtatggggtgaagtctctcattgattaaaaatcaaaaagttgaataacatataagtgaaagaaagacaacatgagcattaagattttgtattaaagtgtgtacatgtcattagaatatatataataaaaccttgaagctgatccttggtagtacaaaatccactatggtcatggttagaataagaaattggacgatgatttgtgatctatgattagctcaccttagtcgtggttgatagcgcaatcatctttactttaccacgatcgtggttcacatgtcaatgctctaattgcatcaaaattgtatgttttcgagctctttttcacatgaaaactcttggacacgtgttgcacaaactaaaactaaactaagttttttccaaaaaaaaaaaaatgtcaaaatgcatggatacaacatgaaaactcgactgacttaatgttacttacctcattgagcacaacaaggcttccaatgccttctttgtcgtcggtttcatgctgctttttgtcaccacaatgttagcttatcaacgacaccttggccttgaggccaacttggtgcacttcttgatgtaactcttcatcattaaccacatatcaatcttcacctccctagaagctctcataggaggagtccctttttatcttcttttggagatggaccactgtttcactagtgtccttgcgtcatcaccgaagcttgacaacgacaacgcgtcggagcctggcgtttagttttcgattccatgtaatttcattttgatttagttgattttataaggtttgtcttttcatgttcgtgcacttcctgatggagtagtagttttcgattgtatttagtttccgattcagtgtgattttgttttgaattagttgattttataaggtttgtttgttcattttcgtgtttgtaccagtctggaatagtgttcttgttctttggttgttgtttgtttcactaatcaagtgatttacaatgttggtttcatcttgtttatttgtgttcctatttcttaatgccaccattaccaaacataattgatctgatctcgtcaattgtctctgcttattgtaacttcgtgtttttttcatttcatataggaaagctaattaactaaatggattggtggatgtgttgttttagttcttgttgatttttatcctcctatttttgttttttctattttcaattgtattttttagatgatcaattaaaaaaaggaaaaataatatataagtactttacatgtttaatagatacctttgactctcattttatctcaatcaatacttaaaacttttatcattgttttaataggttcttcccttaacttaatgctaaatatatataattaaaaaagtctatttatatccttgatttcaatgaatatcaatggttggttatttttgtatttaaaatattaaaatcatataaaatagttattaaatattgttaaaaaaatctagttattcaggaaattgaaagaaaaactaaaggacccattgaatgaaatgtttcccttggttgatgatttgcatgaatcaattcttgtgttgatatatccgtattccactatgtccctcattgttgatgttttgccctagaatgaaatgaagctcctggtggaagctttacattttatgtttgtgttttcaagtatatttaatctactgatacaaataaacttaagaacaaaaggtacgtcccactaattactgcatgcaataattaatgtggaacgcctttgattgtcgacttctcgacaattcttacactataacacttcattcaagtgataggttatcaaaaagtaaatacattttgttggtgtagataataccaattaattttcttaagtcatcattaactatacagtctcatacttatacaacctctatatccctctcattccgatataattcgtttggaatgttacacaatgcattaatggtaaaacaaaagccatgcatgaagcattggaatccttctcttaatttcttgagaattggtcatagcaaaagaataaaacaagatccaagaataaactatattactagttatgattgtcaaaaaaaatatttttatggtcctaagtcaaagaccacatgtgtccctcaacccactggatcaaagactaatctcattcgtagtacgtgattgttgcttatccaagaaaatttagcatacgataaaaataaaacacgattattctgctaaatagatcattttcagtcatgtgaacacaatgagaccttacaccactatgcaaatcctttgggtttgtcaaagattgatatataaatttaaaggaaaggaataattcaaaaatcttaaaagatgctggaacaatgtctcagtctgggtacatgcattctatgacttactggaatcgcatcaaactttaatcgaatgaaggaaacttaagcaagaagccgagagatcacttttcattcactatgctgagtataaaaaaaataaaaataaaaaaaaataaaaataaaaaaaataaaaaaaaaaacctttccattcactaatgaaactcacttgaaggagctacaagatctcggaaattaaagctataattaccacaaaaatccaatacatttttgtctacatcagctaacataatactttatggggtgagcattaaaatccaataaaattgcagagttgacaatgtacagtttcctaagtatgtctatagcaagtgggtaaaactcttcgcttttcaagattttcgccatgtcactttgcttggtcatcttcgaaggagtagaaatcaaaaaggaaaaagaaacaattggcaagactaatttttcatcttgcattagatcttttcggcttcagccatcttcaaggatgtgaatcccagtgtagggatatttctcatatccgccaaaacacaccaaaaagggatccgcaaggtcttattcgcatgggtggaagaaaaaaattccacagaatgtacaattgctgaagctgtataaatgcagagtgaaagccaacagccaacactcttgtaatcagccactctaatccccaccaagttggttactttatacctgaagagaagccttgtcttgaaggaaacccaccgggttgtgtcctataaggtttctcactagcaaagcgtttgtccgatggcccagcacctaggatcccgagtgagttaggatcagtaatccggactccattacttatggtcctttgaggtggtggctgaccctggaaatgattgtcactttcagttcttcttcttcgtttccatgcctcggatttcccagtattatcaactggttctggcatttgataggtagccatattttttaatcctctttgcctctccatatggcgatggaatggatttccatttctgctaaatgaaacagataatgacccattggcgtgagaggggccaacccctgcctcatcttgctcctgtctaagtttggaatatatttgatgaagcctctcccctgaaagatgggaaaaggtggacacatatttccacagtcgcacagtcattcctgtaaataagcaaaaacaaaaaacaaaaaaaaaaaaaatcaacacgtggtagagaatcctaaaaaccgttaatcaactcttgagaggcaataggagaccaacagcaaaaacaaaaggatatcatacaaaaacaaaacagaaacctttccaagaggaatgaaaacttactatcttgcttatagggttcctgttcatgttctagcacaatttgatctatccttctcccaagaagttgtaaatagttgcgtatttttgaaagcacctaaagtagggaggcagtaaacagtgagacaataaataaaaaaaggacgtactacaaggaaataagccaaaagacataccttttcctttggaagattggcactagtttgctgcaacctgtgaagacgtttcaaagttttcatttcttcaaccatcacatcttgacaccattccatccattttacctccttaaactgctcatatacttcctcattgtcagacatttcaccctcttcctttactatagattcaaccttctggggtttctgaaatctatcctttctcatttggacattaacagaactcgattttttctttttctcctgcccacgtaacagtgagatattaatcatattttctctctctttcttggaaggcttccgtccaactctgctgttggcatttttcacaccaagaactgcaagttcctatacaacaagaaaatcaagacatcatggtaagtgacaaacaatgaagatagattcaacaaagagcgtagcatctatcaacaaataaaggtacacaggaagaattaaaaaagcttagtaggaaagtagatcataaattggtgggtgggggatgttaacatgcacatgaaaagattggggtattgcttcaaatcatctttaatcaatggaatacacaaaacgagtgataaaaaaatgccagcattcacatccctttggtacactaaaatatcaacaaattggtaaagcatacgtcttggaacatgtcacagaagtggatactatgaatgcaagtcaaataaaattcagggctatgcaggacaatcattagcgtggaaactaaagtccactaatttacaaaaatgaaacgaaaacaaacaagcgtgcatgtaaatcatatagccaagatgatagaatacacagccagaaatctcctatttacgcaagtattataatattcttgattctgaatctgatatcagtctgagattaaacactcatatacattcactcaacaaaattcccttctcccacaactttttgccaactctattctgactaatagcatgcatattaccctcaattcacattatgaccaccgtactatcatgtgtagcttctccacctcttattctcttctttctagtaaataccctagtgattgagatataatacatgtgaaacattaaataccaaacaatgacatgaagggtaattaacaaagaagaataggaagcatgtaaaagcattagaaacaaagaaagagcaaagaacaagcaaaaaaagaaattaaagaccccnnnnnnnnnnnnnnnnnnnnnnnnnnnaaaaaaaaaaaaaaaaaaaaaaaaaaaaaaaaaaaaaaaaaaacataatgctgaaataagaatttagttaattgcatacttgctccaaaagggcattagcacggtctttcaaatttggagctcgtggcaagaaagtttcatggtgttgaagttctacaggtgcaattttttttgtaaggccaagtctttcatctaatctaatcttttcccaattaccaaacccatggtaatgtattccaagaagcaatctagcatcatcaactgaaaacaggcaaaatacaattagcaaagcagcaataaagtcaacagaataatatcacaaattatataagaggatacacctactttgattccatccacaacctttggaccagtttgatggtttgagatatgacagaacacgaaattgtgcaataggatcttcatatcgaccaatgcgttttgccaaaagttgaagttgttggacacgggtaactagatcatttgccttcactggtacaccaaaaaaatccagcaaaggcccctggatgcaatattattagatgttataagcttctaaaaaaataagaatacaaataaccatttcaaaccctatctattatagggaacttatcgttataccaacctttgcatctagatttccaagttctattgcttctgtacagccatcaataagagcattgaaaagttcaatctgtgctccaggtggagctgccccaacagcaccaccaacctcggcaacaattaagtcaacttggctctcattgccatatttcataacctggcaaattaattggggatgaacataaaataggaaaaattatttactgctaaagaaaataacaaaatgaagcattttacaagacatacatgcacaaacagcaaacacaaaatgataacgcacaataaaagaaaagcccaaagaacaataaaaagaaaaggttattcattaactcaagggaggtgtaaatgcaacgtcaacacacccacttgctatgacccacagggcagtaccacaattaactctatcctaaaaaggagcaaggaagagatcttagatgctgacaaggaatagatcactccctacttaaacagaaattaaagaacaagtacaacgtcaacacccacttgctatgacccacagggcagtaccacaattaactctatcctaaaaaaggagcaaggaagaaatcttagatgctgacaaggagtagatcactccctacttaaacagaaattaaagaacaagtacatgtcaccataaaaagcatgtcatttctgtaacaaaaacagcaaaattcaagaaagcaaacactttccagtcaccatgaactccattttgtgctggctttaattcatagtcaagcttagcctaagactatcatgcatgcacaaaagtccatatgattttatataattcttgaagaaaagaatcaacatcaacagcacctttaacccaagttaattggggtcggtggtagatgaacccaatgatagaataccaaatattaattgcttccaagtaatgtatatggaaacataaattatagttttatattcaatatattagtaaagaaacaaactctagaatcggatcggttagaaattcagtgccacctcaagctcatagcaccattaatccatgcataagccaaaaatttagcctatccaaccggctaagtaaaatatgaagaaataactattcagttctattctgctcaactacaattttatggtcctatctcagatttctaatctttacaatacaaacttctacgttctaaagtttaaatgcagatcctacagcacctagttagctaactttttcagaatggaagagagaaaatagcatcagaatagtgggatgaagatcatcaacaatatattaatttaggaaatgcttctgtctccaatataggaagataacaaaagcaatagattttgtttatagtgagacaacactgaaaattgtgagaagtattagaatcttactgaacgagaaaaacgaagtgcgtctcttttagataaattcccatatgaccaatttctcacttggacagatgctccctcaatcattggtactgcaggagcggaatactctgctttccggcgtttcgaaactcgttcagttggttcaggttccttcttttttcttttattacttctttcagatggatcaacctctgcataacttttaatatttctagcagatcgaggaacaagagcttcctacaagaaccaataaagatgaggcacataaaagaaaatcaatttaagcattaactgaaacaaacattacacaaaattattagaaactcaacaacatttgagaattttttaataatatatctataaaagaacaggatcaaacctctgcttcgaatacagcatcaggctttatccaacggctccagaaacttccatcatcttcatcattgcaaaaattggcaacctgtaaaaagtaaatagaaacaacttagcaattcctcaccatatacaaatctatctcttcccaaaccagagaaataaagatgatatcaacaaaaaaatcaattttaaaacagaaacaacaaaattcacagcactgtccaaatatcttgccttaaaagcacccaataattcatttccttgttccccgtcagcttccttctcttcaactttctctgctctttcaagaatctcatctatatccatacttaagagtcgtttcttgctttcttcatcatttctttcttccttaaaaagctcctctgctccaaatcgtaagattgcagacagctcattctgtcatttcagaaacaaannnnnnnnnnnnnnnnnnnnaaaaaaaaaaaaaaaaaaaaacaagtctgcataaactaaaacaattcaatgcagtccataaatgatgaaagcaaggtaataaatattcacatgaaattacagttttcacaaatgtccttactttgtcaaaataacttcccccttttttggcttctttcttttccagtctaccctctgcatttagtttttgaatcaccaagtggtccagaacctatggaacacattcacatgaaaaatgacataaaattgttgacctcaaggattggcaataagcaattgaatgtcttttaggaaaaaatatacattaaacataaaaatataggatgccaaagttggagaaaaagagatgaaacaaaaacagccagcggatatctaatgatttttaacataccattttcttcttagcacgttccagaatatcttcctcaacacttttgcttgtaacaaatctatatatgttaacaacttcttgttgtccaattctatgagctctactcattgcctaaaaaacataaaagtaacagtaagcaccaactatttcattgattaataataaaattacatcagctaaatacctgcaggtcattttgaggattccaatcagaatcaaatattataacagtgtctgctgtggcaaggttgatacccagacctcctgcccgtgttgacagaaggaagcaaaaatcatcactaccaggtgcattgaaatgatccatagcttgttgtcgaagctcagcttttgtactgccatcaagcctctgaaattgaaaccctcgaagtgacatatactcacccagtatatctaacatcctaaccatctgcaatacaactctgttaagttagaatcatcatacactaatccttaaagcacatttcttttgtttcaaaaattaaagcagactaggatgcttagacaagcaacatcaaaagttagaagttatttatgattttcacatccacctgttcatgaattatgcacaagaagtaagtcctaaatcaatagtgaaagatttaagacttcagagagaccagcaatcatatttgttcaccagcaatcagtaatagatcgatcagtatttttgtcagcggtaggtttatcctaatcaattaaatgaatttatggtttcagttcatagattattcaaaggatttgaggtcttgaagaacaatgttgatcaaactatttccctatttttttagatctgtaatagatcaatcagtattttcgtcagcagtaggtttatcctaatcaattaaatgaatttttggtttcagttcataaatgttgagcattaggacttgaagagcaatgttcacataaaaagctaaacagtcaggtaagagataagaaaattcctcgaccatcaccctttaacacatgcacatacacaatgttcagcatattggggttggggggacttaaaacaattagacaccaaaattgattcactacaacacttgtactgtaacatattttaaggaatggttcacacgtcaataactggagagttattgtcattgacagctgataaaaaaaattcaatctaatttccttccctagttctattcggtcaattagaagcgtaagaacaacttattctttcaattacccctggtaaagtagataacaataccagctaaatgagcatgcttaataacaccgagacaaaaagcagaaatatatagtttaatatgatatatgtcattgaaatacatcccacaccactaagtttaagtgaataatggcacataaaaatgtgatcacacaaacattccagtagatcatctttaaaacaactaaaagaaaattttatatttattgcaactgaacaaaaagtacacttcatagttgagctaaactaaagaaaaagtatgatgaaacatcgttgagctaaaagcttccaattatatcaagaagcacatccagtaaaccagttttaattttcaacaacaaacctgagagaaaatcaaaacacgatgcttggtttcatgcaatctaacaagcagcttatcaagtatgacaagcttgccactgctaaaaacaattctctctagtttactgttgtcactacttcttgagtccccaccatagccatggtcagcactttcaaacaagaagggatggttgcagcacttctttaattccaccacaatatttaaaagagaaacctgaaatttagcagaaaaagatttgtgatgatctttcaagagaaaagaatatagaaatatacattatgaattaaaacttctccgaattgtcagtccagatgataataaacagatgcaacatttcattttaatatcttctcccttttttttaattcattttgggtattttttactttcataatatcttctccctttaattgaatattaccaacaaaaaaaattaaaaaaatgtacctcagctccttgacatgcacataaatttaccttatactgtaatttttttccacttaaataaaaaagggaaaaaaacataaaggctccttaaacttttctccttttacaaacagacaccctaaactttatgtctcaattcagtcaattaatccttaaactttatctcttctgcaaataggcaccatgaactatatttttgtttcaatcaatccttaaagtttacgtcttttgcacataaatacctaaatttcaatttcatctcaattaattcttaaaaaattatccctttcattaataatcttgtgttaaaataaatttaaattaaattaccaacaaaaaagaaatttctaaacttttccaaacattaaaacataataaaatttaggatcaaaaaataaaatggaaattttaaaattaattttattattacccctttatatatatatatatatatatatatattatttcttatattttaaatatgaaaaatgcgttgtaacaaaaaaaaaaatcaatgaatgattaacatttaagataaataacttgaaaaaaaatatttgtaaaacggataaattttaaagatcaattgaaatgcaattaaagttcaaggtgtctatttacaaaaagattaaagtttaaatatcaatcataataaatttaaagtttatggtgtctattcgcaaaattgagacaaaattaaattttagggtgtctatttgcaaaagaagtaaagtgtaacggagtttaatgttattttcccaataaaaataagaaatcttaaaaataataaactgcactaactctagcttgctactgttgacaatcaatgaagtttgcatggtggaaagaaaccacccatcaaagccaagtattggcatttcctatttaattaaccatcatcatgaagaaagcacatgattcatgtacgttatgaacaaacgattgttagaaacacaggaaagggatgtaacctgattcccacgaactcctttgttcaaattgtgaaaattacgttccaaaatccacttataatacctacacgaaggaatacatcaacaggaatttagaaagtgaacttacaataatagtatttttccaaaagaaaaaactttcagaactaaaattgcacttactgtttctgaagaggcgacatttcaaccctaaggatacgctcaattttggggggtaatgatttctccacatctttgataactcttcgaagtatgtgaggtctcaattccatatgcagatttgcaagctaagaaaataatttatgcacatcaaattacagtgaggcagaagtcgagaatctcgagatcaaggaaaatcaagaagcagagaaaaaaagtaaagggtatccatgacaacttatacctcattctcattaaaagaactcagattcttatagttttgaacaaattcatccttgctcctgaacttgtccggatcaaggaaatgaagcaaagccctacaaaacagggagggagaggggaggggaattgtcaaacaaacaagaaaaccaaagcaaacaaaataacagacaacacacataatagaaatcaatttagtggacatataataagaaacaatcaatcaagggagtctcccaaaaactactaaactctgtatttgtgagcttgcataaatatacatgctatttatacaataatgaaaagtaggggtgcaagcggaacggacccaatccgcgaacccgcctagtctgacccaaccagtttagaattttgtggttggattgggtcattgaattggattggttttatttttatgaacccaattgtaattggattgggtgacaggtttaaaattttggacccaataaaaacccaacccaaccagcatatactaaaacaaacataacaaaatactaattatatattataaattaaacttaatagtaaattactaatatagaaattagaaaactctaaagctaagtcaatcagtcttgcaagccgcaatagcgtttctccctaaaaccctcgccgtcatcaccatagttgtaaaaccataattgaacgtggcatggagcaaatgaacaaaggaatggagttggttgacttatcttttgtaaaacaatgttatatttaaggtttatctttttctatttatcaggagttgtacaatgttttatgaacacagttttttaaaattatcccttactttttttttagtttaaggattttcttatttttttttaagacaaagatgtggttattttttaatgacccaacttgataaccaatccaatccaattaaagttggataggattgggttgtaaaaaagaaggtaatcccaacccaatccaattaagcttaattggattgagttgaaaaacacacaaaattcaacctaatctgtgggccacttacacccctaatgaaaaggcaaaaaactagaagcccccttgcggggtaagactggaggatgccatgatgtaagctgctttaaatggttaatgtaaatgatatacaaataactcatcatttactaggtcacacatcaagcagttaataatatcattatattcagtaatagcatttattaacatttatccatacaacaatattaagaaatccaacaaatccacaaaagatgtaagtttacttttttgacaattcaaatacgaaaggaaaatgttaatgataccatagttcttccacactgttctgtagaggagtaccagtgataagcaacttgttcttggtgctaaattcctaaaagattagcacaaaacaagccataaaatattaaattctatcataaacaattgcacagaaataaattaagagaaatgttacatactgaaagtgtcgtgtacaactgtgcctcactattttttagcctatgagcctcatccaccatcagataattccatttgatcttagagagaacagccttatccttcaaaactacttcatatgtagtcaacagtgcattgaattttattggcttcccagtttttttctcattataaaattcatattgttgacaaacctgccacaaaatgaaaaacaaaaaatcatatgtaaaagaaataaataaaataaaaagcttgcagaatttaggcttaattatattttttggtccctcaaaatcaaagttggggtctgtcttttttagtccctcaaatttgcaaaatgctttttctagtcccctcctgactgatttttgacagtttatcgcaagagggactaaaaaaacatttcgcatatttgggggactaaaaaagatagacccaaaaatttgatggactaaaaacatatttaagtctaggctttttaaaaacataacttaaattcaaagaaaaatatcaaaaccacatccacttactccgctgagtatagcttaaatttcttttcatgtagcaagaaataaccaagcaaatcaaagagaagtatacatccatagcaatatagggaaaaggtgattaaatgctagaaagacaaaatttgaagcatggaagacttgacaaaattcataaatcataacttaaagacaaactcagaaatgtctcacctctcgacttgcacgagtaccaacatatatgataatattcatatcaggaagccacttcctgaattctttggcccaatttgataaagtggacaatggaacaactacaagaaaaggaccatggatttgctgggcattctgtgcaaggaacaacgtattattacattgcaagggcaagtgtaatcaaatagagaattgatactacacctgcagaaaaccaagcatcgatactgactgaacagttttcccgaggcccatttcatcggctaaaatgacatttgtatcgtttctccaactgcaaaatgcaatacacagatttagaacaccaaaaaattaaaacgtaccttgacaaatatacaagcatgcatacctgttaacgagaaaattcagaccctcaagttgataatcacggagctttccacccttcaaccattcaggttgttcctcaagcttccgcaaacttgctaaacatcaaaaccaaagattaaaatcagaacttacatagataatatcatgatattctgtacatgaaataatgaaccaaaatattctttatatggtattaaaattaatcaaagaaccaataaaaggaaataggcttcagaaggcaggaactacaaataaaaggaaactatcaaataattctcaatcacccctctccaaatcaactttctcaaatttaagcttaagtaatgataaaatgcaattttagattgaacagatcaaagttaatcgttaataatctgatatattaaaaaataagacacgtcatctttgcccagaaacagaaaaaatgaaaaataaaagttacatcctctaaaaaaatctaatacaatgttaaattacatattaagaacatgtagaataaaatggtgacacataaatgaccaaaaaaatttacacctatatctataaggttttctcaactacaaagtttatctttaacgtaatcaattaaaaattgtagttttgcatattaaaaattattttaataatctactaagtagaaaaggagtaatacagtatacaatttcctcaataaagcaattttaaaagtgtcctaaaagatttcacaatataaaactagtaaaaagtcacacctagagtccaatggctttccaaagaaataccaaattcataccaaaaataaaagttcaatcatgtcccagcctgctcctatatttaatagagcagacatgccatgaaaaaaatgaccctaatttgaaatataatcaagtaaatcaagactgagaagtccctcgtgatatgaacataaccgaagtggatttctggtacactaaacaaattatagtgatacaacataattggtaaaggtgtacgaaatactgttggtctttttgtttagtaatttaattccaagaacttagaaactatattgttgtagataaaaatgataataacacaagtttaccacaccagcgaccatgtcaagtgcatacacagaatctgtcgaaatgttccgaattttattgaaaaaagagcactgcccacaaacaagtcgaggagtctaccaacctttgctcttcttacgctgagaatctaccatctttccttgaactgccatagcagcctcacgagcctgttcaaatatggcagaacaaaaagttcattgtaagataaataggtaatatccaaattatcatatataaatcttattaacatgtatgcattgcaataaatacaacaaccaggcctagtctattcctagtgggttcagatgtgaaactcccaaaactaccctaggagataaccattcttagcactgctctcaaccaagcatgcacagcaccagaagtttaattcaattgaaggcagaaatacaggagatggataataacttccataagaagaatgactacaaccacataaggaacttttcaaaaccaatacaataatgagaatagagtgaaatagagacttaccttatactcatcaatagcatgttgagcaaaagcaatatcaatgtccttttccctagtacatcaagagtgacaaattacatagaatcaataaaacagaatagatgccttataacagagaaaactaacatcatagtatcatacttgctaaataaagatctaaaagtttaaaacttggagtacaacaatgcttagagatcaatccatcctcctctctaacatgaagacactcaattcacagaaaatgaaacaaaaaatataagtaaatcataactaaatttttagcgtagtgtaccaagtcgcttcagcataagatagtccttgccacttgaccaagtattctggaataacattgccagaattatctttgctgatcctatctgcaattattctttccacctgaaaatgcaaataaacaatccaattagcaaatagcaatacatcagagaaaacaagaccgaagtaatgaaaatattggaatgcaggaaagcaaacctgactgttctgtttgataatatctagatccatctccttactaacgtcattaacctcaatctgcatacaggaacacccaaacaagaaatttttaaaaaaacataaataatatcaatgttcttttccggataaactatttccaccaaataaatttccacaaaaacttctgcagtatttatagcctccagacctattaaataaactggagcatctaaattgattggctgaactcaaataattacctcctctcttgagattgtcctcctgtacctgatgtcttccattattttctttgtataattcaaaaccttcttaaaaccactgagctgcaatctcacataaagacagaatgtattaaattttggccaaaaaaaaaaaaactcaacatgtgaaagagtaaaacaaccaaacaataagaagcaggattgttataataaaaaacagagactgaccgaaagacagtaacaacagaataacaatgattaatgcataataaacaataagaataaatatcatacgttttgcagctcagcaaaagatttccactgacagtgcaaatgtgactgccctttccattttatcaaaaattcgatctcattccaatcaatttccgaatcaaacaagtgactcattaaaacaggctctgttgatctattattcctttgagcatcttcagccatgccctttggctgatgccagagcaccttttcaatggagtcaccatcgtcctcttccatttcttcctgaagagcacttaaaagaatcacatcagtagaaataaatttaaagtatatattaagtaaataggaggtatcataatagcataactaacatctcatactcccaccagaaagccattccaatataaaaagcttaatagcctaataaaatcatcattgctagattaaagtacactaatccttttgatagatataataaactagaattaaagaaggcgtctacaaaaaaatgacatatatccactccgtactctaacaaatctattatccttccagagagatagattgggaaatctcaaacatcaaaaccaatgcagctgaaattaccatcttgcatctttagcatcaactccgtcaagcaatcagcaaacctcataactgagatctctccaccaccaccacaccaaaagtaaagaatagaacagctggcacaaattgcaaacataagctaatggtctccaccaagtggccatataccactcaaaacaaaatatccaatttcataagctttcttcaagccagtaatcattctcttttctctcactcaaagacaatatacaaaggataaaaaacatcacctcctttcctatatccttaaaaattctcaattttctgaatgacgatttaaaacaagacttgagtgtatttgttccaattctcctcagtaaaacacccaataaatttaataatcctatctcttacgcacgatagttcatactataaataatgaaaattaaaagaaacaccaaaataatagataactcaacaatcatcagttcatttcaacataattccattttttatttttttcccatcacattgaactgaaacagaggaatagaaaatacattattttcagattttaagtgcattcaaacataccttccacttcctacgaaacattaatctgaactttaattttgctggtaaaaaaaaaatctgactttaaatcatgcaatctcacatccactcacccccaaaaacagataaaaacacacatcttagaagggctgcgcaggtggacataagatactagttacagatataaaaaatattgggacaacttttttgtggtcattcatgtatcctaatttggagccaaccttcacctagtaagataaggctttgttgttttgatgtatccttatttggaacagttttagcaggttaggtttaaaatggtgatggtgaaaagtaggtgaaaatttctgggcactacacagtttatgcagcccattcatgtacttggttggagctgtacacttgcaactttaggggtgtctctctactctgcagcttaatttcatttaggattgtgcttttggctccactataagctgctcggatccaatgattatttcaatggagtagtgacttccctctcttctttgtaataaataaatctttttttgtcatcaaatatatgtaaaacttatccttgttaaataaaaccacaacttcctaataatatactaccaattttttttaatcaataagaagaaaaaaatgtctaaccagtagtcatttgcgatgcaagtgaaaacatcctttggagggtatgttatcccaagtgacatgatgatttgagtcttatatgtgagaatcaatatttaacatttaattttagtagataaataaaccccaaaagataggaggtagaaaccatgctcagatgtgtataatgaaggttgtaccttttgggactttttctttttcccttcatcagcttcttcactctcttcactttcaacatatgataccttcctaactgtcctactagaagtgcgaacctcactgttgcgcaaagaaaaacctgtggctgaagatgatcgaccattgttcttgcggacatgaacactccgcttttttgtgcttttgaaatcctcatcactatcactgtcggaatcctccgttgttgactcgttggcctcaaaagatgatttaacccttctttgtcgacctgatgcagcatacactttgcgatctctggtagattttatgttttgtccaatcttacctcgttgccttcctttaggtcttttagcatagaaagattcatcatcatctgagacaactatattttcgtcactgtcatcatcttcatccgagccttcaccttcccaatctttatcctgcaaaataacaacagttaaaccatttgatattattaggaaacatccaccaaaaaaccaagacatattaacttcaaaagtcaaaactagcagtaaagcaaaatttgtcctctaatgaacatatacaagcccttactagataaaagaccattaatgaaatagaattcagcaacaacaataaccacaaataaatgaccttgtttccagcatgaacacttgtggcgggctcaaagtctgcatcgtcaggatcatcttctgcatgatgttaacattaaaaaatcacagttgttcttcactaatcagaactatgtaataaaggccaaacattagctattttaaaagcagtactccatacttaagaaacaatctttatataaataaaatgctcgacataccatctgcttcgtcctcttcttcataatcagcatcatcaccatcatcatcatcttcaccatcattatcttcaacatcatctgaaaaccttgaattcctatgcaaagttctacttgcagaggtcgacatccgttgtggccatgaattcgatccagtgggctttttgatcccaccgtaatgcaatgagtcactttgctcttccccatcctgctcataatactcatcagacaacatctcttcagcaggaacatcagagtgacctcttggaccttttcctgcctccttttgtccatcatcatcatcatctgagtctactcttcccactcttccatccaatgaattatcttcagacccatctgcatttctataatctgatccactttttgattcctgcccagattcagaaccattttgagggtccatttgcccacagtccttccaaaatgttgaaccccaccttccgaccatagctgttttactaccagtagtctgcaagtttgattctttcacagcatccccatcgtcggctgttgcctcagtttgcagtctagtggaaccatctggttcaccatcactctcatactgtgcctccatgttcatatcaaattctttctcactagaagttgcatcagtacaatcattacctactgatctatgaactctattagcattctgtccttggcttttatcttccatgacaccatgtgagactgtatcatttgaaaagttcctaaagaaagccatcctgtaacatatgactaacttactattatctttacttcaatctccacactggatgcaactaatcattaaaaaaaaaaaagtgacaaaaatccagtgctgcttcagttatcttctgtctccccagtccccaagacctgaaaaacaaagagtgatatacgatcaatagaatcctgaatgatgcccagctcatgccattgatcacacattgatgatataaataacaacatagaatcccgtattacaaccatccagcaagttagaaaagacgtagaggaaaagcatcaaaccaatttacatcttctgcaacacttctacaaatacatacttacaaaaccaccaaacatgcttagctcttagtagacaaattagcaggttcaagtgttcaatcatcagtgactccatagagttgcaattcctttacaaaccacaggttaacaagtgagttaaaattcccatgctatttatttccacacattctctagcagatgtgcaagttgaaatgaaataacaaaaccatgctccaggttcaattcaagcggaacttgtaccaggtatggcaaattcggtttcaacttcaaattctaggttaaaaacagtcctatatgcattatcctaagttcacgaatgaaccacattgatcaaggagtgtaagcactgcttcaaacgactgtcaagtttaacggtcaaaactgaattccgttaacactcgtatttcgccaaaatcgaatttcaacaccgtgcaatgcacaaaaccatcagcatcatatcaaaaacaagttaatctccgaaaagcaacggcaaaaccgaatcgaaagggataaagcaacggatcgagcagcaaactgaacgaagctcgtcactaaaacccttaaggcttggagagcgcgaccttcggaacaaaaaaccgacctaaatccgaaatcggaaccctaattccgaaaccgaatcactaagcaatgagcgaatccatgcgccgatgatgcaagcaagagcgagcgaacgactctcacctttccacgtgcagatagcagaacagagttccggcaatttagttcgaacggaaggaaccgcgacgagtgacggtgcgcaggttaataattgtgagcgctcttcctccgataaggactcgccggaaacggaatcgccggctacgaatatcaaaagtatagaaaagagagagtaaaagggacagaggaatcggttgatgtttcaggaatcgcggtggagcgagattcgaatgaaggagcggcggtggcggagagattcgccgagcgtggcggtggcggtggcagcgggtggtaacttccgatttagagagttaaacgacgacgcgatttggattaaacgacgatgattttcagatgaaagggggaagagagtctttttgtttgccctttttttttttttactctagagagagacacacggagaataggatatattaataatgtgaggaaaaaagtttttttttttttttatatttggagaaacgtttttttttttattaatttggagaaacgtttttatatacactctttcagagtttcagtctttggtttatctttttttaattcctttaatttccgctgcctcatgagtcatggtggcattggctcttgagtgtaaccaactatacgagtccacgtggcgatcatgttgggtggtcattgaattgtacggttaaggtaaattcgtatttatttctgaataattctaaattttcttataactatttattattagttcacttaaattttatagtaaatactaattgtatttaatatttgcaagaaattaaatataatcatattttctttataaaattttaatgtttaaattttaattagcaacctagtttgtggaacgtaaagttaaatattcatctttatataataaaattaaaatttataataaataaatatttctaaaatatataacactataattaaaatgtgtaataaataaatattttagatatcaaatttacgataaattatttaatttttatactgtttttttaactactgacaattgcttttaaattattaaaattaaatttaaaaataaatataaaaattataaattgaaagagatagataattaagatattattagattaaaaataaaaacatgtgactcgaccagagtaatcgtaacttctaaaaataattttatttaagaaaactcctaaaaatacatcccaaattaattcaacaaatataaaaattatagattgtaaggatggataattaatatatgagatgaagaaagaaaaaaacatgtgactcgatgagaatgatattaacttctaaaaatattttagttaaagagaattcctaaaaatataacctaaaaacattttcgttaaagcataactcacaaaactaatgaaattcaggtgtatatatataagagcatattttaagaataaaaatgcaaattaagtttagagttgtggtttattattcatttaaatggaataatttttcattttattatttataaaataaaataaaatatcttagaagaattttatatttacaatttatcaatgatatatttagatgagatttttattctgaatgggctgggacaaaatatctctcaggccctaaatcaattaactttcaaaaaaacattagagtgttacttgcaacattatataaatttctccatatactatataaagtttaaaatggcaaaatatctctcttagcaggttttaactccatggtgttcagacttagtagtatatgtattacgtaatccgtatgatttctacggatcagttggtccatatggtttatatggatttgttaatctgtataaatcatatagattacttaattcatatggatcatctgatccatatggttcatatgaatttgttgatccgtatagttcatatggcaggtgtatttttaaataaatttttgaaataaaatttaaaaatgtttataatggtttaaaatgaattttaaaaaaaaaattgtgtatcccttctaaaatccggttagtatggataaattggatacttaggtatgttatgatttattttgattattttgaatgttatatttttgaaaattggatgttttaattgaagtagtatagttcatcatttgttggattaacaaaaaaaaaaaaacagcacacataatttattaatcgtctcctaaattgacatggtaagtgcgtacggttatggaatcactatacatcctcattcgatcaatataaggagttggtcattgtttcgctttattggaacagtgtgttgaccaaccgaatgcggttaatgggataaaacattggtcttgtagttgtacctttttaaataacgttgttactaaaaatttaataaaccaaatatgaaataattaaatgcttcaattaaaacattcaattttcaaaaatataacattcaaaataatcaaaataaatcataacatacctaaatatccaatttatccatactaaatcttccccgaattttagaagggatacacaatcttttttaaaattcattttaaaccattataaacctttttaaattttatttcaaaaatatatttaaaaatacacctgtcatatgaatcatacggatcggcaaatccatatgaatcatatggattaccttatccgtatggactatatggatcaccttatccgtatgaaccatatggatcaacgaattatatggatttggtaatctgtatggtttatacggatcaactgatctatatgaaccatatgaatccgctaatccatatgaaccatatgaataagctgatccgtataaatcatacggattacctaatccatatacaactaagtctaaacaccatagagttaaaagctgttgaaagagatatttttgtcattttaaactttatatagtgtatgaagaaatttatatagtgtaagaagtaacactcaaaacattagaatgcaaatcacccttgaaagggtccaaagcagtcagaaacattacaacaaaaattgactagttattataacttatatatgtttttagtttatctcaataagtttaaagaacgttgaaatatttttaaaattattttagtaaattttataattacaattatggataaattaatatatataataaaaacttactcaacaatttttaattagattgttcaatcaattacacattaaatatatttatgttttcatttaatgttaaaataatattaatattatagtatgtgaaatatattaaataaatttttactttaagatagctaggattttattttgtacaataaacaagataaataaatattttaaatttataaattagcttataatttaaattcataataactaaatattttgaacatataaattatattttaaatttataataaataaattatattataaaaaaggttaattttattcttttttataattattttaaaccattgaaatataatttaaaaataaatatgaaaacatatttccatcaaaggtatttttgtttaaaaaagttggaggttaacttagaaaaatgggccggaatagcaaagcatcaggtcattttgggaggtacaggaagcaaaaatggaaatgcaggaagcaattacccaatgcaactctttgttggttcaaggccgtcaagtaactagtaaaataatttttttttcttatggactgtttcctttaaaaggtcatggattgaatttaactcttttaaattataaaattcactttaaagagaaaataaaaaaatattaaatttaattattaaaatcataattaaatagacaagcatgtataattagttatataacaagtaacgagtaattaagtttttacttgtttaaatcttaattattatttttttaatatcataatcataattccttattttatttttcaaagtgtcttgttgttcacttaaaaggataatgtcactacgcacctaagttggcttcggaagtggtatccactaatcagtgtcacaatttacaagttctcgatattttgataataaaatatttgtcgtcaatttcggatgaaaggaatacaaaacagaaatggtcaatgtaatacatttttaggacatattcggattaatttaaaattttaattaggattaaacttaagtttacagattaagtttataaaaatatcccaaatattatttttttaaaactgaattttcagataaaattttgttcttaaatatattttaaaaaataatcaaacatgatttcaaacacatttttctcttaaacatacatttggatgttttcacccaaaatccaaaatccccttgctttttacttgttattcattccaaccaaacgccatgttctctttcgtggagtaataataattccatcacgtaagataacataactacagcatgtgaaaaaaaaaacacactagctaattatcttattggatttttcttaattatattgtgaaatattattatttatcattaaaaaatatcgatgataaaattaatatcatgtattttaatcatgaatttatgataataaatatttattgttagacttttgatatgagtaatttgtgatgaggtagattgtttacttataacatttttatctcaaattgggatcttagactatttttcagtagacctcatagtgtcacatatgatatttcttccattttatttttaatggtaaatctcattttgtgatcttagagagagaaaaaaaaggaagaaaatttattcttatttgaacaatgtgcaaatcttaagggatcttctacaaaaactcatcctccatgttagagatcttttcaacttttttattagaagatctaataaaaatcagattttgaattgaggtgtcaaaatagatcccaccaaacattggcccttaaaaagatcgattgacgagttagattgagttgtgaaaattatgattctagcttattttgatcctctttgattttagtgtgttgttaattttattttaagatgaatattctctttatatgcatatttttgttttcaatttcgagttatactttatttttaattattatgtattatattttgctattttataatataaatggcaacctatgtttttattatagtttttaagtgattaaaaaatattttgttatattgttatataaaatttatttttttttattttaaaagatgagtgacccatgaacttgcacgtttggcccacagcctgctaaggacatgggtgatttgattcatgtaccttccaaaaattttaaaatctcaaactatcctcttcatattatacttttacataataggtattttataacaataaaaaacaatttctaaaataggtgttttataacattaaaaaatagtttccgcattctgaaataggtgtttcataataataaaaaatagtttcaagaataagtgttctataacaataaaaatagttttgtcttctaaaataggtatttcataacagtaaaaacatagcttccgaaatgcctattacataatagtaaaaaataattgttgaaaataaaaaatattttatgtattccgaaaagcctattctgaaacaatctatgttctgaaatgaccattctgtaagactactatataacttctagaatcatgtctatagaataatggttgaaaataaaataaaaattacaaaattgttgttccggaagacaaaataccatattccagattacattcttaccttcaatgatgacgtgcaaaggaaggaggagggggaggacattctgcggcgtcatgacttgtgggatggaggttgtgagactgtcgtgaagaaggtgaagtcgtgggagaagaagttatcattgcgggtgaaggagatgtcatcatgggagtaagtttggtattttcaaacaaattggaaagtgcataatacacatatggagtgcataattcaaatgccaagactaggttgagttagaaaaaaaaattggtaacctggcttgacttgatgtaaaaatatattggactaggatgatttggactagctgaaattagcagctttatcaatgcatagtcctcttccaatctaattcgaccataaaattatcgtcacattaaataattttacatttataattgtgataaatcctagttagtgactagttattcctagtcatcatgtatagatttttttttctctctttatggtgatgcatcaagattataaaatgaattcaaataaaacaaatcttaagatattttttaatgagaaaaaaagattatgcattgatttacattatcgtccaattacaatttatcatttatgataaatttattaaatttttaaaaattatcttaaaaatcatgcaaacaataacttgtaatgaattacaatataaaactattttatttacaccgctgtttcttaattaaattgtgtgattgttaaaggttttgaaaaatagtccatatttgcaatttttactacaatgttaaggtttatgaagtcttcacaattgcaatgcaacagtaattgtagctccattagtcgtatttgtctaaaaaaattcacaacataaaaaatttcgacaaaattacaatcacaatcatgactgtaatttaaaacctttacatgctactgttaaattatgtcacaatatgcaaaatctattttctaaaattttagcataccttaccaaaatcacttgaattatgataaagcagagggaaaaagaaaaatgtactctgatatgacatctcctagttttcattatgcaggtgataaatatttcctagaatattacaagcaagtagtaaacgaaaaccaaggaatctaactccaacccccatgtattgtacagactcctaaggtactatcaacattaattccttttcccctttagcatcattgtccaactatagtaaattttccagtatgcctacaacatatgcaagtctcttgttcccacaactaagtgttaataaagagaaaaagaaaaagaaaacctttaaaactcaaatgacaaactagttaggaaaattgacaactttaccaaccgacaacattaacacatgcaaggcacatgtatagagtcggctttttcttttatttgttctttaacttttcctttggttctttggtagtagatcactgcttttggaatgcgtttggttgctttgcttgtgcaagcatttcaaccacttccctcatagttggtctctccacactttgttcctgaacacatagcatggccacaaagaatatctgctttgcttcatctaagggaatgtgacatagcctctcatctagaatcttcaccactttgtctttgctccaatttgtttgcaacttggtccattgaacaatgtctagaccttcttcaccaaaattccccactggccttctccctgttagtagttctagcagcaccactccaaagctatagacatcacttttctcatcaactttcaatgtgtatgcatattctgtgatatataaatcaaaatcagtacaccataatagttggctttcacattttagctcaaaagttaaagtcactatgcctatgtatgacagtacaataaatgtcattgttgaggaaaaaagagtttgagtataaaatataatgatgatgatggtgatgatgatgatgatgatgatgaaaaagactggctacttaatagttttataaacaaacaagggaaaagctttatttataattttcaagttaaccaattaaatttgtaagaagacaagttagtggtgccttgtgcctgtaaattgttcaattttatttttctggggtttggagaaagtaaatattagatctcaatctggtgccttgatgaaagaagcatatgcttttggtggctcttatggatatgttagtcaaaaaaggatggttgtgattggctttggtttgaatacgggtttacggtttcaaggcatgccaaagcacaaacccagccgcggatccatatgtagttgagggtgggttgatgcatcccctcatttcaataaaattactagtatttatcataaaatattatattttacatctcataattttatattttacaccttctaattttatgtatttgaacctccttaccagttcacatgtaagagtaagtaaatacatcatcttattttaataaaatacaaaaaaaatatcatattttgcaccccataattttatattttgaattccttaattttatgtatttgaactttcttaccagtttacatgtaagagtaaataaatgtactatcttattttaataaaatacaaatatttatcttaaaactttatattttgtttcttttatcttcgtgtttgaatccaactatctcatataataatgataattatcaatttttattttttaaataaattgcccccaatgatccagggtcctagatccgccgccgcgtggcagttaaggtgaggaaaagcaaaagattgaataattttgcattgtgttagtggagccttcgaccaatctagaaattcacgtacatgcagggataaaataaataaaatatttttgtgctaacaaaaaacagaaaaagtatattaattcttctattcccattgacttttttactatgaatatttgattgttaaatggacctgaaataatcatctctgttgatatcccttgaccttattaacccaacccactgcagttggcctagtagtgaaaattttggataatttgcacaatattataagttcaaacttaactgttgtcattgtgcataaaaatacaaataaaactcttgaggccttgacctcaatcatttcacttggtcaaccttttttggggagccaagcaacaatgtctcctaaacttggaagttagagtgtatgtaaccaatataaatctactagaagtagttataatattgtagactaactgatttatatatttaaatattaaaattaagtacctggagcaatgtaaccataggaaccagcaatggaagacatgcactctgatgtcccagtatcttgcaagaacttggcaagtccaaaatcagcaacatgagcctcaaattcagagttcaataatatgttgtttgacttcacatctctgtggattatcagaggggaacaatcatggtgcaaatagcaaagcccttttgcagcttctgttgcaattttcagcctagtatcccactttagaaactctcccctcttcccatgcaagacttcacctaagcttccatttggcatgtactcataaacaagcaaattggtctctctatttgaacaaaatgccagcaacctcacaatgtacctgtgcctgattcttcccagtgtccttatttctgctgagaggccattatcatgagaacatcctttgttgattcccaagagcttcttcacagctacttgctctccatttgacattgttccatggtatacaaccccagctccaccccttcctatggcattgctttcctttatgcaccgtatgatgtcttcacttccaaattcaagattctgaaatgttgtgagcttccatgaattggagtgccttctttgctttctgctcttgataaaggccaatgttgcaaatgccaatgaacaagccaacagtgccactgcaaagagaagcttatacttcccaggaactccaggtcttgcactgccactgtcttgtgactccaatactgcatttgaagagtgtttacatggattcagctcatatccacagagccgaggatttcccacaaaggatgtaaagttaaacactgagaattgcccctcctcaggtattgaaccagagaagtcattgtgagaaaaatctgctgaagtcaagcccttcatggccccaagttccttgggaagactttggcttaggtggttccatgagacattgagatagttcattatgtggatttgagaaagctgaactgggatagggcctgatagttggttttggctcaaatctaaataggtgagcaacaaacagttacgtatctcgggaggaatactacctgaaaaattgttgacactcatatccaacttgagtatatttttcagcctccctatatctggagggatttctcctgagaatctatttccatgaagcagcagaatttgcaagttgggaaagtttccaatggaaattggtagagagccggataggcgattgttggatagattcaactgtccaagtttagagggtgcagtgcttgtttgttgtggaagccaaccactgaggtaattgttctgcaattccaaaagggccaactcaggcaagtaaagaaaaccatttggtattgatcctgtcaaatagttctgtcccaaacgaactctttggagtctgtagcattggccaagatcagcaggcaaagatccaaacagaaaattgttgagcaggatcaaaatcctcagcctcctcccaaggcatagagatttaggcaccaatccagtgagcttgtttgttgacaggtcaagctcggccaatttgctattctggccaagccttgatggaatggcacctgtgaagttgttctgccaaagcttcagcacttccaagttaggcagctcagcaatgaaaggtggaatttcaccatgcaacctgttgatgaacaagttcaagagggtgagctcatgaaggcctgagaactcattagggatgtctcctgtgagctcattgtttgacaaatcaagacacttcaggctactcatgttgcctaattggggagggattgagccactgagctggttagtttgcaagaagagagtgtctagtttgatgaggtttcccaactcagctggaattggacctgtcaagccacagtttgcaaggtcaacttgagttaaactaaccaacttaccaaactcaggagggattccaccatcaaactgattgtagtatcccaagaaaagctgtctcaggttagtgagattcccaagctcaggtggtatgagacccctcaaatcatttcctgcaagagacagaaagttgagctgaaccatgtctccatagcttggagggatttcaccaaagaaatagttcccgccaaaattcaagctattgagcttggggagctgagtgacaccaagagggagggagcaattaaactcattgtcataagcatcaagcacttcaagctctctcaactgagaaaatttccatctcatgtctccactgaacttgttgccggatatgttgaggaatcgtagcaattctagcttgtgaatttcactagggaaccctcctgagaagccattaccagcaagtgaaacactcacaaggctccttagtcctgtgatggaaggtgaaagtgtgccagaaatgttgaagttggatatgtccaatgacaccactgacctattcttttggtcacactgaataccctcccaggtactgcaaagggacatgtagttagacatgttccagcttctcaaagaatcagtgttggcctcaaagtcttgtttgagagaaaccaagatagaggcttgccttctcaaagacatgggaagagaagaaacagaagcaggccaagttaagcacaaaaggaggagtacaagtacaaggccaagagttacagttcccatttttgggattaactagcttagaagttaaggatatgcagttggaataataacaacaatatcatagagttatgctgaatatgaagtagcaggtggtgagagagagagagagtgtgtgaggagtgttatgtgttgtaatgttaagagctcagaggtaacagtgttacagcatccaatgtcctcttctcttttccctctcttcttttctccgcacacaaacatacatacacacactactttggtgtcatctctagcttttaaaaagcaaaagcagtgtttggatagaaaatgcttaaccacggaccgtttcacaacccagttaaattttatttattttttattttttcattttatttgtattctgtcggtttttgagcctagtagcaccacttcctttagctttttctttctttctttgtttttctttttttgtttattcataaaccaattccaccagagcagctgatgaatcagatttggatgatggggatataatcgtagaccatattatagataccaatcatgggggagaataaattgatacaatgtgcatgctgagtgtacctttatttttttattaatttctggattttgaaaaagagaatgtggtgggggtgtcatgaatggaacttaatttttgttttaataaatgagaaattacaacgattaacctctctctctctctctctctctctctatatatatatatatatatatatatatatatatggtcatagaagctaccgtactatatgtcataaatcatctatttcatttcataggcttaaattattgaataaggacacctgaatgatttgtagaaaaaaggcatatctctaagagactaacagaaattgtatttatataatttctctgtgtacaagaatggcgtgataaaatagttgatgtgatgaaaatagataaagaaataacattgcatggatgaatattagatatggctagcgttatgcatagaaggagaaagaaatttctgagcaacatgaatattagatatggctagctttattcagccaattcgaaaaaccattgatgtttcataacatggttcatgcttatatgaaaagaaaaaacaattatcagggtatcaattcatgttagtaatcagaacacattaaagaagcacgtgttcactttggcatgtccaaaagtttatttaacgcatcattaatttaaaatcaaggaatcataaagaaaaaagttgttttcatgtttgttatgctcaatcagaagatgaagttaggaatcatcttttaaaatcgatcgaggtccttctccgcaaattccgtcacgaatgaattaaaaggaagaaagaaaaaaaaagacagagatgaaaaaggaaaagggaatgaaatttaaagtatatgatatggttgatccagccacatcaaaatgtaattttaaagaacttggcaccatcaggatcaggccatcaacataccaatcaatacatgttagatcccaattgctgaactgagaaagtaaatctcagaaacatatgttcaattttctctttctggggttttgagaaagtaaatcttagttcccacttcccaatcctagtcagcccctccccaaaaaaatgaaaatgaaaataggaaaaaaaattgatgtatatgaattgagtggcagccaactcagaccagttatagatgtaatgaacgagacaatctgcatgatttaataatgaggacatgaggatgcaagaaagcaacctaggtcagctcataaactccaacagtttaatttctttttaggtggataccattggtcccctggacccctttctttctttgtatttagtttcccccagtaagaataaagtacattgctatatatcgtataataataataaaaaatatgaatattttttacattatcatctgctcatgaacatgatctgataaatttattaatttttataataattatctttaaaatcatattaaaaataatttttaattaattaacaatatattttttttttctaactagttgttagtacaatgtttattttatatcaaggtcgagatttgaattctaaagcattgaattaagaaacataagttattattatttgtgtcaatcattattgataaaaaaaaaaaaactttacaatgtatgtttgttaaactgtaataatgataataattttaaaaggtacagtgttctacaaggagcctcgcagcctcttttaaccctttcgctttgcaccctaacgtgaaaaagaaaaggcaaagccatcgattcttcttttgagaccatgttgggatccatcatattgatctcttcaaaaatgtaaatttctcgctacaaaatgtggaccagtttgaatctttctttttaccataattgtattttgatgaccaattggatggcaggggaagctaatattgggagggtgctatggttgaaattgaaggcataacagttggggcctcatagagtgattggaaaacatgctggtcccatttctgggaattccttgttttgttttggggtagtggagttaggacccatttctagcattaagccactaaaaacaagtactttagtttaggcacactttctgcttcagttgaagatttggaagatggttgtcctaatcttggttccaattgggtaaggttcgtggcatcatataatgtataataaattccaaagtggtctagtctaacctgtgctgctgtgcaatgggataataatacatatgaattattgttatttatatataaggagcaaaaacagcactgggtacgggtctaaattgaaaaatcacatttagaccttcctttcatgcacctcatgtttatctgatctcacccactgagcaaaggggtcgtggcactggccacaacggacgcagaagctaaataatggcagcgatatagatatgcagagaaatcttatttgtcccatctaagattcctagtttacgagccctctgtatatagatggagatttgcgtgtaccagctcagctagtcacgctagataacacgtttaagattttaaattttgaattagggtctgacaaattacatacgatggacacaaggaaaaaagtttatttttttgttatttcctaaactatgggacaatttattgttccaagtacaaaatcttcaacaagcaaaaataatcatttttattcataacttgataattatatttttcttttttccactacaatctttagttatcaacttcatcatcgtcatcatcattactatcatatttatcattattgttgacattattttcaatatcgttattgttactattatttataacattatcattgtcgtcaccacccctataattgttatcgtcaccattcctatcactaccaattttattattgttgttgttaccattaccctctttagaatcatcacaattggtgtcaccattacgtcatcatcgttatcataattaaaaatgtgacaacttggtggctaaatatgtgaaataggagaaattatgagtaaattataaattgtacttactgaaaaaacaaatgttaaatgctctaaaaaatcaagtttgaaagtagaaagaaaaaaaaagttaagagaaaaaaaatgagaacaataattgaatttggcaagcatggaattgcactaaaaaattgtaacactagaaatgctgcttgtgatattgcccaatgcctaaactttatggggtattgagatgacataagagtcctttatttttccttttctttgattttcttaccttgtcattgtaacctctaactcaattacatctctttaaagaccttgtgatttgcttgtgtttatttggttactagtggagatgaggttccgtacccaacctatagtaggacactttgcattgagaagttgagtaaaacggattttatcctaaaacaccttagtgaagtgagatgagtgaacttgtctttgcaatcattagttttggagatgagcctctaattggactttatttgattatttgcataacaatggttatctgttgctttttcttatacttgagttatgatatgatgaatctttttattaaaaacttttgctcatgataattgcttgaggacaaacaaatctctaagtttggggttgtttgatgtgttacatttagtcttttaagtgggaagcattttagttaggattatttgcattattggttgtttaggtctatattttttgttcattgcattgcattttattcttttgtcaaacttgttatgtcgtgggtgttttcacgttacaaaagccatgttgactagaccttcaatgctaaatgaagcttttctagtgcatgttggatttccaggattaaacttgatcatcaggaacatgggctacaaagtattgatcgagaagagaaaagccaaggaaaatcaaaagctcatttaagtcgttaatctctaagtcaaaacccttctacaaagtttttctaagttatttaaagacacaaactaaaatttgttcataccaaaatacactaaaacgcacaaaaataagaaaataagtcatcaactaaaggacacgctcgtgccaaatttgtcaacaacctgatcaagaaataaggggcttagcacgcccgtgccactaaatgacacgttcgtgctagatgcataaaagcttgattgcgacataatggacttggcacattggctccagatggagccattcacaaatagctctattttccttccaaaaaggtccttgatgacaagtttgatcctaaaagtccaacatgcactagaaaatatccatttagcaccaaaggccaagccaacatggctcctgtacacatgaaaacacccacgacgtaacaagttcaacaaaaagaataaaatgcaatgcaataaacaaaaaaccaagacctaaacaaccaatgatgcaagtaatcctaactaaaatgcttcataattaaagactaaatgcaacgcatcacaccaccattgttgttattgccaacatcatttgtcgtcattgttaccccaattgccattactatcacaatcaccatgaagataattaatatttatttgatcggtattaagatgagtagataataaatatgaattgtattaagataattaatgttaaaaagggtaatatagtaaatttcacattattttgactatgtaatccaatatccacaaacaatgcaaaaggaaaaaacttgtcatataacttatgtgtttgttttgtattgttctccttatgctattctttggtatgtatcaaaacaaatcctcacgccttgtttcgtagagaggaaaaaaaatgaatgaattgaaatacgtgagaagcaaaataaaaattaaaggtattggttgaagataatagaaaataaatgaagagaaaaatagaaaaatgagtgaaaatagtacaagtgagttcaacaatttttataaatgtttccatcctaatcatatctaccaaacaaaccaacttattttcatctcttcctatcctctctaatttttctctatcaaataaagtcataatgtgatttacatactttaaaacacgaatacatataattacacaaaatgttacatgtttcatagacaattttaactagtttagtaatttataacttatttggcaagattataagtttatttgactaaagtaaacaagcttatctatgacgaagatagtttcattctaacttaacaagaatttggatatcatgatgaacccaatacttatttttcatgatgtatttatggaccggagtttaattagtttggttaaatagttctgggttgaatatgatcataagcatttttttcttaaaccccatactattttacccaattgctttagtgaaaaaatgttatgtattgacagtgtaaatttttttatacagtcatccaatcacaatctatcatatatgataagtttgttgacttttacaataattatctaaagtaattcaaacgacaattgatgattggataacagtgcaaaattgatttataccgccattgcataagcattaaactcatttcttaaaccttttttaacttgtagtttcatgactaaactttgcaaagctttattaattattggcttaaatatgtttttggtgcttgtaagttgacatttttttaatttttgattttgtaagtttatttttttaattttagttttttaagttgatgtcttttcaattttatttcttgtaagtttttctttgtttgattttagttcttataatataaagtttttcaattttagtccttttaaccttcatattctagtgttttcatttatagtctccataaattcatacttatagagtccaaaatttttaaaaatgtaaacttacatgaattaaaaataagtaaaatatcttatagagaccaaaattttaaaaacacaaatttttagagattaaaattataaaggtaaacttagatgaataaaaaataaaaaatgctaaaccaaagatatatttaaaccttaattcttactttagccgatgattgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcttggtaatatataatgatatgaaagaatatgtatacatgctccacaataattaaataagaaagacatacataatgatattaaaatcaaatcctatcgacattctttaaaaaaaattatttatcaactgtgttaaatattgttagatttttttatagactagttttaagtttgaatattttttcaacattcataatttttttaaatcttataaatttataagattcttttaaatcttaaaatttaatgatacaaatcttttaaaattcaaactataaaatcttcatcataattttttttaaagaaaattatataaattattacatttttccaagtcctttaaatttcacaagaattatttatgcttaatttaaaatccgaatctaatacgatctaatgtaaaatgtgtgattagtatttctctaatagtatattttaaaattataatttcacatatttaaaatgggacatattattattatatgtgtgtgtggttttgattttttaaagtgagacaaatattgttgagaataaaaaacacttataagttattatcgtgcattttctctaagaaattaataatgtcaggggacatgcatgatgatccgaattattttgagtgaatttttgaaaatcaaattagacatttactgttacaacgaaggtcgtgaaacctctaccaatattcatcaagatgaaatatattctagcattttttttagaagattatagtccatctgtttcattgaaatgtgaggattttttttatatatataataataacttcattttcactgctgtttagtgggctagatgtgaggcggttccggattattgggtctagtgatggcctttgttatttgcaccctgtatagctaagtccacacactgttattgttgatttttttttttttttatgaaaatacttttgattaaacatgtttccattgtgtattgtgtatttaggagtgtgtgactcaccacaatattctgtattgcaccatcaattgttttgaaaacatagtgactggcatgtcatatttctaaatgacataattattggactacaaatattattattatatcattagttaatattgtcatttaactataaagattaaaatcaaaagtattaaattttacataccctacaataaaataaaaaatttaaataataaatgatcaaaatcaaaataattatattatttacgaaccaaaaatcctatttaagcattttttattaaattaaaacatgaaatttgtcttatcagaatcatttataagaaaaatatgaaaaccaactaatgtttgaaccaaaattagatgcaaagaaaatgaaaattacatgaatgaaaaatgagtttcacgaataattaatttttttaaaaaaattaatatcatattcttttttgattgctcacgagatttatctttcacatgattttgggtctcattgcttttacataaataagtttaataaaataagttttacctcttgaataaattgaaaaaaattaaaatagtgctaagaaaatgataaattttgttgaaagaactaacatgtttttaattaaataaataagaaaaattagtactattattattttaaattaggagactaatttaaaaataaataaatcaagagcctcaaattcatctctgaaaaaaatgcaataggcgcacgggagcagtaagaagactcgcacacagaagattgtcccacccgccaaatatctcctccatttccatattctattctcataaaaccctaaaccccgaattgtagtgtttagggtttccgtttccattttctcaccacaccatgttaaccgcaatcctcagaagaacctgttccactctctcaaggcgcggtttccccgccgccttaatctccgcctccacctccaccgccgccgtcggaaaccacttccggccaccctccgcggccttcaattccagaaccttccactctaacgctggccccttgaatttccgctcctcctcatgtcatcgcgcagaatacgccgtcgacgatttcccttacgaagaaagctccaaagggaacgccgccgacgaaggcctcgagatcgcgaagctcggaatttctgaggatatagtctccgctttggccaagaaaggcatcaccaagctcttccctattcaggtttgctttgcttcctagggtttactcgtcggtgcataatatgatccatggttgataattaaccctgtgtagtttagactttagatgtttagtaactttgagcttctgttaattttttaattaattaattattttgttaaattgtagagggctgtgttggaacctgctatgcaaggtcgtgatatgattggtcgagctagaactggaactgggaagactcttgcttttgggatacccatcatggataaggtcattcagtttaatgctaagcatgggttagttctattttttttttatgatatcggcatgcttatgtttcgctattacttgaatttgtaactttttctctgcgtgagttaaaggtggactatgcaattgatattggtgtggatggaatcatggaaaaccttgagttgttttttaactgtacaagtttttttgtggttgatgtggcaggcgggggagggatcctttggctttggttttggctccgaccagagagcttgctcgacaggttgaatcggagttctgtgagtcggcacctaatttggatacaatttgtgtttatgggggtacacccatctctcggcagatgaggcaacttgattatggggttgatattgctgtgggaacacctggtcggattatcgaccttctcaacagaggtgctctaaatttgaaggatgttcagtttgttgttcttgatgaagctgatcagatgcttcaggtgggctttcaggaagacgtggagaagatcttggagaggttgcccccaaaacggcagactcttatgttctctgcaacaatgccatcttggataaagcaaatttcacgcaattacctgaataatcccctgaccattgatcttgtgagtatgaaattctattttaggctattggagaatgcctttaagctgttgcaattctgagatatcgtttagttaaccggaatatgactcctctaaaaaaatataatgtagaaacaccacctagtatattaagttgtagggcacatgaacctcattgagaaataagtttataatatctaaatgtacatatggtttgtgcatgtgtgcgcaagtgagcacatgatagttactttttaattggaaacttattggtgctgtaggttggagattctgatcagaagttggcagatggaatttcactgtactccattgcaaccgatttgtatgttaaagcaggaattctttcacctctaataaccgtatgccttctgaaaccatcatttcttgattgctagttcttctgattaacgatttttactatcatttctgtttcataagaagtaggttttgaaaaaaaattgttatttttccacagtttttaggggtgagtcttggcccaatggtagggttggcgccttgactcgaaggtcacaggtacaaattctagaaacagcctttccgcttgaggtggtaaggctgtgtacatgtacgctccttagacccaattaggtatagccttgtgcactgggtcacccttttatatatttttaagggtttactatctttttagttcctaaactttataggatttctgtttttaatccctgaacatttttttactgcttttagtccctcaatttttttttctgttccgacttttagtaaaaataaggatggaaaaatgttaagtgactaaaagtaaggacagaaaaaagtcaatggacgttgatcagtagaaaaaaaattcaggactaaaaacaaaattcctaaaaagtttagggactaaaatgatagtaaaccctatttttatttagaaaagctagttaaggaaacttcttgctggattttttttttgtctctcctaaagatatatcctttgttaggaacatgcaaaaggaggaaagtgtattgttttcactcaaacaaaacgtgatgctgatcgattatcatataccatggcaagaagtgttaaatgtgaggctttgcatggagacatatcacaaggtcagagggagaaaacacttgctggcttcagaaatggccatttcaatgttttagtggcaactgatgttgcctcacgtgggcttgatatacctaatgttgatcttgtgagttgttttatttctttgaaatagttaagttggctgacccattggaattgtgtttattgttaattgaattgcaagaaaactcctatttttccatgggtttttctgctgcttatcagttattattaccgttttcttctcaatatatctgagatattaattacttatgtaaggacaaggtatgcatatgataactcacttgtctctgattgattactttttagaattttctctaatttttagagtgggattctctacatttccgacttgtatttattttcatcagatgttctggccatagctagtatgttgttgaaatcaatgaatagcttctgatatttatgatgctgcatttcctcttaattttttgagcaaatttgctttacaaaacaaatgatgcattttcaaaagatgggctgtacactttctgtgtattgatgatattattaggtatgtttccatgtagaacaacatattttagcatctgatcgttcattcttatctgctttcagagcgttaaatgttcgttcttactttttagcaatggagcaatactttaggtgtattcttgccaatgttctgtccgtggttctataaattttggacctcagattttattttgttgcttgatgtgttattgttttgtattttgcggtctttatcaatattctatgctttactttgtttaacatgtcatgtgcatatgcaaatactttcatatagaaaatattgttaccatgttattcaattttttatatgtgaagttttaacttggtttccttctataggtaatacattatgatcttcccaacaattcagagatatttgttcatcgttctggacgaacaggtcgtgctggtaagaaaggaactgctattcttgtgtatacagaagatcaatcgagggctgttaagcttattgagcgtgatgtgggcagtagatttacagaggtgatctcctggcatcctatcaatttctgccctttttactggaagttgtagcttgttaattagtaattttcttgtgattgaaattgaggataatctatttttaattactaacaaggataacacaacctcctgccttaaatcccacccttcctgtgcacaatgagatttaaacctgtgaaatccctagttaaagcagttgatgttgaacaattagagttcccatgtagagacttgctgaaatagtttagtattagtttgcgagtcaggttggcaggttgcaactaatactggtaaaacttgagttactgaaaatcttaattttctttagtactcttgtatatctaagctgccagtgaactactatcctacagttattacttattactactgtttttttttttttttttttttttttttttttttttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggattacacatagtagggcatcaatgtaaatagaaaagtaccacttgtactcatctatatttaatataatacatatattttgctgataaaaaaaaaaatgctcttaaaaaactcaccatgattttatattaaaagtataaaaaggaaatttatagatcagaaatatcaaacttgaagagaacagatacctctccagtctgagatgtatacatcgccatcttcagtgtgatacatccatcttagatatgacttttcttcaccataaacgggtctaaggaaccctattatagaaacaccatttgaaggatggttcattcttttaacatataccatgttgttgatggcctataagaaaattcataaaggatcaatgttatttcttccagagcctatgaatctgttaaatcattctcatgttgaaacttgaaaattagttattagttttcttcttttttttttgtgcgtgtgtgtgtgtttgtggggggggggaccttttttaagcactttgagaaataaattggatgaacagagtttgtagtatcagactgtccccaattcactggaatattaaactcctccatttctgaaacctgtttgcagaagaatatacttgtgatttgaatttctcagatgcataaaaagaaacaattagtaactaaaacaactgactaaatttcataatttaagcatttgaaaaggcaaacctcaatgtcatcatcatcaaatttgaattcatcatcgttgccattattgaaaatgtcatattcactagcagtccttctattattatcatatattgggatgtccattccaaagaaagcattctgaagaaacacggacttagaatatcaatttcacaacttctatgtcaaatatagggatggaacacaaaaataccatgacaaaactacttcagcttatcatccaaactacaaatttagctctttaatagttgttgcacaaagacagttgaatcacttaatactttaaaatgactacataatctctggatctatattaataatttcatataatttgaaataaagtatctcatctatgactggctttttattttgggagaagacatgaaatctaactgggagtcccaattacataaaaaataaagaaaagaagagcatcaagggaaaagtaggtgcaagagattagaagcctaagacttataagttataaccagaaatattgtgcacagaggtttgacagaaagacccatcacatgattcccagaagcaaagcatttgggggttcttaaaatgtttactacctgcaaattccatcaatatttttaaaaagagattaaatattttttttataaaaataattcttatcagatgggaagacaaagaagtaaaagaacaaaggatatggaatattcattagagggaagaaaaaaaaaagctcaacagcagaacagctaagtatatttggccaatctcttagcatgtataacaaagaaatccctttgaaaacggatacaaaattcctaccacaggattgttggctccacaatccgccaaaaggtttgcatcatcagagatttcaaaatatatatctacaggaaaaaaaaaggaaacaaaagcaataggttataattactgaatcaggaattcattaaggtaactaataattctcatttcataaacaaaaatatatgcataacaaaaagaaaacaaacctccaacatcatcaatatgatattgaaactcagcccatgaaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttttttttttttttttttttttttttttttttttttttttttttttttttttatatactgtgatgtttgctctatgctaattacattataggacagtattatttatttatttataatgattaattgattgctttttattcctatattcgtgtttatcagctaccacggattgctgttgatagtgcatcagtggtcatgggtggtggcatgggtggtgggagatttggttctttcggaggtaccagggatcgtcgatatggtgatacgggttttggatctggccgttctgggggctacagtaaccccggttctggccgctctagctttggaaattccggtgaaaggtttggtggacagaattataatcgttttggttctggtaattcatctggtgaaatgaatagatatggtggaccaagctctggtcgttttggatcatctggtggctttggttcaggtcaatcaggaagtagatctggcggatcatccagtgggtctaggtttggtcgctcagatgattttgggggatttggtggttcagatcgttcgggtggttttggagattttggctcaggtgagcctagtggctctggtggttctcgtggtagtaatcagaacaatagaagacctttttaacttaattaacataaatataaaaaaatgcaccatccttatttatggtggcttagttcttgtagagtttgcgtctgtcatttcctctaaaacttacaggtttcttggctaatccttgtattactaaggattttagaagacagaagttctacggccattggatttttcttttcttttctgggacttttggctcagtctcaatgtgtatgttctttttgaagcatgtaaaaggagaaaaaagggagggctgtattctgcgggttccatcatctgccatagctcattacttgtctgtatgggcaacatcagcacgggcagttttaaagaggcagctgtatttatatttatgttccttatagtagtagtagttaagggaagatcaaatgtcttggtaacctgtagtgtagggtgctttgctgttttattttatactaaaaatctattatgcaagaagtttctcatctactatgtaattttggttatcaaatatttgtttttcgcccttcaccctgggtttcataaggggtttgattaaataatttgggaatcacgttgtttaaatcctgcctttcccggtgttcgtattttgcctaacagttgctagatttcgttgatccacaaggaagtaatgaaatgtttataaaaagtaaaaaaacagcaagaggtagctgaaggagcattatgagcattaaccctgcacgtgagagaaaaataggacgaaagaattgtagaaattttttgagtttcattatttgcttgaagattggagggaaagtagaaactattgacttttaaaaattccattttttcaaattatttttccagcttaaattttaaaaatctgtttttctttttctttttctttcctgtcatttgaacgaagggtaaatgtaggcgaggaatttcttagtatttgtttgtatgagcgttgtaataaaattaattttgtaaaattgatatcgtttaaaattaattttgaaataatatggtttatgtttgtatattttgttataggttaaaagtaaaattcaatacaaaattttgaattcaacattcagaattattttgatccagaattaattttgagttttctctaacataaaattaaatatatgaaaatacattcaaaattaatttctcaaggtcaaatcaaacacgcacttaatgtagcactaaaaaagtacaaccccgtcggatttaaaagatttcaaacttgtgttttggattagaattttttgcattattaaattcatatttttatattttttaatacttttttagaatgataatattgtctgacggaatgatttaatctaaagtaactcatttcatggggtttagtcagagtgctaaaaaaattttcattcattactagatgggatgatttaacgtaaagtaacccatctttggattttttttataaaaaagttaatgttttaaaatgctagtatatatttaatacattttaagttgttaaatattattattttctgaataacttgtgttgttatgaggtttagaaatttctaaaattctaatatttcagggcgccttttcttaaaatatagtttttgaaaataaagttttcaaaaccaaatgttaaaattaatctgaagataaactttattaaaaataatgaaagtatttttttctattccaatttctctcgcactccattcttttttgttatcccgtacgatctttcacataaatttgatgattgtcaaacaatacttaactgcaggaagtacattctaataaccatttcagtaaacatgacaacattttatatttaagtaatttcttttcaaataaatagaaactagtttaaaacaaattttaactaaagtaaatttagcttaaaattggttataaacaatctcaatttataatttttatgtaattttacatattgttgatgcgtgattttgaattttggatttatgcgtaaataacataatagatgaatctttaaataaatataggatagactcatgaccctttaaatggatataaaatagattataatatcatcttagaatatgagtttgaatataactcaccttcaaaaattagctcatgaatttaaataacataatagatgactctttattctttaaatggatataggatagactcatatgactatttaaatagatataatatatattataatatcatcttagaatatgaatttgaatataactcaactccagaaattagctcatagagtgaaattatccctcacttatatactatttcatgatcttatctttagccaatatagaactcatgtttttctcaataaaaaacaacattaagataaagccacgttaattacattatacacgcttccattaactgtgccaaattgttaatcttgattctctaacaacaattaatgataattaaaaaaatagcagttatacgacaattaagacacttctctattgtgttttgtgccagtataaattatttacacacgcataggtatatgaccttaaggtagtgaagggggggactaagccttaccatgtgccatgaactaaaataaacagattttgaatggtattcttaaggatactaaaataccaaaaaactttggcttaacttttaaagttaacgtcaaagaaaaaaacttttaaagttatttttcaacttaaaaatagcttgagccaaaaaaaaaaaaaaactagacgaaacacacaaatatatagttaatagtaattcttaaggatactactatactggtgatgcggtcaccaaaataatctgctctagctctggaatttgtctcgtactaaaaggttggaagataaagaatgtactgaatacaaaaactaatttgtggcaacatcttttatattttgtataaaccattgtaaaactcaaaactataaaaaaaaaatgtgctaatcatatagaataattgcatattaaaaagatcatgttgagaaatatcttgaggtaacagttttatccataaatgccatcacttattattcagcaaagacaaagctaacattttaataacttcttatctataaggaagtcagaggacgaaaaagaagataaccgccattgacccctttcaaatctaagtaaaattatagggccaacaggggaatgatttagctggtaaggatcaaccaagtaaacctggtgaagcttaggtttagtttttgcagccaccaatactcctttctggagtgacaacacccctacctcctcttttcctaaactctgatgatttaccaaaaaaattatgttttggatttacccggaaaaaatgtacagattatagaactatttatacaagaaatcaattgctccagatcagactctaccagcagtttgaaaaggacaaagtcaaaaaagaaggaccaatcaccaagggatactcaaatcatgctggcactccgccacttcttcatattcttctttcgccgagagcgaggaaacaatagttgccaaatttgtttttcagctgcatttgcattggcggcctgcaaatgggagaaaaaaaatccattaatgaatttgaaaaatgccatactggacatttcttctttaagcaaatttatacctatcgccccatagaaatgcttatgtaggtccaagcctatggagtgaaatagcctacgtgattggctcttgctaaccattagataaaaatgccttaaatgaacagttgtggactgtaaaggcttctttcaagtgtggtcaattacacaaacacaacagtgtgttccctcttctgatcacgtgttcatcaccttaccccatcccacaaccaaccaatgacaatacaacacatttgttgcattttatgcagcagtggccctggagatttgtacttgtcccttctctttttcatcttcatcctaactaaaccgttaattgagaagcccacttcctaaatattacaaaaaatacatttttggagaatcccgttcaaattctcttcctgtgtgctacacaagcatgtgatatgtgtgtgacaaattagttgacttagaaccttggacttgtagttttgcttcaaatattattataataaattcatcaaataatactgctctagttacaaaataatgccaataaaatattttttgggctattatataacattggatttattttaacattagcatttaagatgccacatcaaacactggataacataaaaatcataagcttcttacacaatcaagcctcaaattatcccatgagagatttttagaatctagattgttttaataactaatagacatgttctcaccaggatgttcaggtgagggtccatgacagaatcaatctgaaataatgtacactcagttgaaacccacaacgcttacctggactttgaatggaaaccgatgagtttttacttctgcacctgaaagaactctaacatccacgccaaggctgtcaaccccaaccaggtaagctccctggaaaccaggtaataacactgaaataaacaactggctactaacagtagacatacaaaatcaaagtataaaaatataacgaaccaaataatagtcatttcctatgcgtgagtgttttgtttggtgtcatgaagggaaatgaataagatagaaaagaaaaggagaagtaaaggaatcatcactttccttgtcagatatcatccaatggaaaataagggaggctttccttcagttatttggtttcataaaggaaacgaatgaagatgtatgtaaataaatgtcaaattattttattaccctttatatgatgaaattgatttacttgaaagatttgcatggtggttagagtggggaaaaaattggattacctcgccataaagacctttcttcttgcaaagtgctttaatttcatcatcacagaatcgattgaagcgttccagaatttccgaacaagagtgtgcaagaatatcaggttcagcatcttgaaagtctagcacactaatttcagactgcaatttttttggataggtagaacatgcataatttgtaatttagaataaatctcaacaaacttaaaaatgcttcaaattacagaaaaatatcggggtttggtaacttgctttctaagaatattttagtaagttacaccttttggtgtatttttaaaaaataaaattataacatgtttacacattctttctaaaaacaagtaggtgtcttaaccacatgggtgctaacatacacccacttgtatgctagcaagttgtgtgtgtataaataattctcattttaagaatgtcagagctataaatctaggtcatataaccatacatggattgtcaagattaaaggttatttagtggtcacatgactacttaaaatagtcatctgcattttttatattttttttaaatcttgactattcagatataatttaagaatagatagatgtagggatagaaatctgttttgagatacatgcctgatatccatacatggagtggagctcgattgacaggatctccaatcgatatagtgtcaaattagtgtctctttcatcatcgtcatcactatttgagttaaaatcttcaccatccaaagattgaaaaggaaaaaaaaagttaaaaggcaatttaccaattaatcaacatttttttttgtcaaagctaagatttcatgttactgaggaagaagaggctctacctcttcaagttacataaatgcattatgctcagagaactacaatgacaagcttcaagctttgttgttatattgatattgcaatattagattagctttcctagacaagaaccaatgagtaaaagtagctgaacccaaacaactagcaccaaagtgtgtgtgttcaataaagtaccacaactttagtcagctaaacaagatccttctgcaatatcaaactcttaggaagtacagagcactctgtcctctttaacatgcttcttcttcagaaatgcaccatggcaagaaagtatgatatcaaatgcatataaaaggtagcctacaaattaataaattactttacataataaaaacattaaagtaacatataaaagttaaaactggatcggtgcaaatgtgtaattatatcctttactccaacttccaacacaagaaacttaacattccccttcaataaaaatctatgctctacaaaatttaattttaggaatttatacagttatccatagagttgctctgataggtaacctatcatgctcttaattttaggtgaagttttgggaagatgtttggctaggtggtgaggagtcgttgttggagatgtatccgcgtatgtacagcatatctcaacaacatcatcactttatacatcagttggggtgtgcagcagaggggggttgggagtggcagctgcaatggaggagatttttcagggaatcggagattgttatggttgctaaattcatggaggacattgaaggggcggtagtgcaggccaaccagcaagacaattggtgttggggggcagattctagtggaagatacacagtggccagtgcttacaaattgataagtagctgtccatcaggcgtgaataatgatggtctgttcaaggagttatggaaaatcaaagttcccaataaagtatcatgctttgcttggaagttgattcgggatagattaccaacaaagatgaatctaagtaggaggaatgtgcctctgaatgacgtaatctgccctttttgtagtaactgtgaggaggatgtgtcgcatcttttctttggctgtgacaaatccggcctctatggtgggaagcattatcgtggctaaacatcgtcggtgtttacccggaaactcctagagatcactttcttcagcacacacatggttatctcaagggcataagatctcagcgctggcaaacatggtggatgtcattgacgtggtgcatatggtaccataggaatagggtggtcttctcaaatgaaggtttcaatgatcaaaagttgttggatgatgctgtttttttctgctggtcatggctcaaaaatctggaaaaaggatttgatatccctttccatccttggccaataatataaggataggattttgtaatcaggggagggtggttttataggatattttttgtggaggggtacaaagacctatatagtcttatggactcctaattcttgcaatactgcagtattaggaagtattatggctccataggattacacatagtagggcatcaatgtaaatagaaaagtaccacttgtactcatctatatttaatataatacatatattttgctgataaaaaaaaaaatgctcttaaaaaactcaccatgattttatattaaaagtataaaaaggaaatttatagatcagaaatatcaaacttgaagagaacagatacctctccagtctgagatgtatacatcgccatcttcagtgtgatacatccatcttagatatgacttttcttcaccataaacgggtctaaggaaccctattatagaaacaccatttgaaggatggttcattcttttaacatataccatgttgttgatggcctataagaaaattcataaaggatcaatgttatttcttccagagcctatgaatctgttaaatcattctcatgttgaaacttgaaaattagttattagttttcttcttttttttttgtgcgtgtgtgtgtgtttgtggggggggggaccttttttaagcactttgagaaataaattggatgaacagagtttgtagtatcagactgtccccaattcactggaatattaaactcctccatttctgaaacctgtttgcagaagaatatacttgtgatttgaatttctcagatgcataaaaagaaacaattagtaactaaaacaactgactaaatttcataatttaagcatttgaaaaggcaaacctcaatgtcatcatcatcaaatttgaattcatcatcgttgccattattgaaaatgtcatattcactagcagtccttctattattatcatatattgggatgtccattccaaagaaagcattctgaagaaacacggacttagaatatcaatttcacaacttctatgtcaaatatagggatggaacacaaaaataccatgacaaaactacttcagcttatcatccaaactacaaatttagctctttaatagttgttgcacaaagacagttgaatcacttaatactttaaaatgactacataatctctggatctatattaataatttcatataatttgaaataaagtatctcatctatgactggctttttattttgggagaagacatgaaatctaactgggagtcccaattacataaaaaataaagaaaagaagagcatcaagggaaaagtaggtgcaagagattagaagcctaagacttataagttataaccagaaatattgtgcacagaggtttgacagaaagacccatcacatgattcccagaagcaaagcatttgggggttcttaaaatgtttactacctgcaaattccatcaatatttttaaaaagagattaaatattttttttataaaaataattcttatcagatgggaagacaaagaagtaaaagaacaaaggatatggaatattcattagagggaagaaaaaaaaaagctcaacagcagaacagctaagtatatttggccaatctcttagcatgtataacaaagaaatccctttgaaaacggatacaaaattcctaccacaggattgttggctccacaatccgccaaaaggtttgcatcatcagagatttcaaaatatatatctacaggaaaaaaaaaggaaacaaaagcaataggttataattactgaatcaggaattcattaaggtaactaataattctcatttcataaacaaaaatatatgcataacaaaaagaaaacaaacctccaacatcatcaatatgatattgaaactcagcccatgaaatctggtcatgtggttcacagtgtaccattccaggaaatactagcaaagcgcttttattagcctaatgccaacaaacagggcatgatgataaaaagtatacagatactgccaaaatgcgcccagcaaaatggaaacatcatattatgtgtactaggtccgtagccctagatatcacaaattaacttgtttcatgtgcacaaaagcatataggcacaaacctctacagttgtttttgctatttcagcaggagagagtctagctggctgaatatcgttggaacctttcagttcttcaagaggatgataaccttgttcatccatgtgatcagaagaatcgggtatagaatctgagtagtctgcagcaacattaacctttgaaaggcacagatcatgccctgtggatagccaaaggaagtgtggtgatccaaaaaatggacttttgcacctaaagataaccaaaactattttcagtaaacaaagcattttagatctttcacgaagaataattacctggacaagaattgactagtgacaagaaaaaaacctatataaataattgcatctatcacagttttttgaattttcaaacaacacagtaaatggaatatttgattgcagaatcaggagaaggaagagactaataaaaatattttgagggttctaggtacttcatctgaaataaatattaggttaccggtagtaaaatcatgcaacaaaactaaaatcctagcatccatccaggattcatgtgttagggttataaaaataacttggactccgcttaacaatttgagttctagttaaagtggattgacattgtgcgtaaaactaaatggattaaacctgctatgctatatagataattnnnnnnnnnnnnnnnnnnnnnnnnnnnnnnnnnnnnnnnnnnnnnnnnnnnnnnnnnnnnnnnnnnnatattttcctagtctcgaattaaaaaacaaactgtatgatcccacatgtactataactaatacagttctataagcaagagaaagctgaataaggataaataatcatccttcatgtaatgtaagcaccttgtgctggcaagatcatgccaccttcggccatcaataggaagtttgattgaattgcttgtttttccataagtagagcaacatatcccctctacaagacacacaatgttgaacaaagatgaaaacaccatccaatagaaagagcactcgaacacaatttaaaatctcaagtcaaagacgttaacacgtgtagtgtaggtaagtatctcaaatcgcataaaacaaaagaaaatctcaaaatgtataaaataattaacaatcatctaagctatatcaatcgaaaacaaaaatctactctgaatcagaattttgcactcactctcatgatcaaattcctaaagtctgcatttagccttaaatttttggacttcttcacaatctgaagaccgaatacattacaaaaaaacacttttaatttattcatttgtttattttgctccgccgaactccacagttctattattgtaagagcaaatgaataaataatataagtcagcattcttcttctttaaaactcgattgagcctcataacttgagaacattttcaccaacgtatgcatgcacgagcacgaaaatttcttataaaggagtcgaagcaagtttctaaaattttgcagaatccaaacagaaaagagaaatagaaacaaaaagcagtaagctcattcgttttattgagaaatgaaataacgaatgagttgaaagagtaacaggaattcggaaattgaatagcagagaaagaagatacttaccagaagacgacggaagtgaagaagaagcaggaggtagaatagccatgaaatggaagatttgggaagagagggaaagtgctttttatatgacagttacagtgatagtgacagtgacggggcgctaacaaacagcgactctggcagaaacatgacgatggcgtgtgtgcgcgttgtgctctgtttgtgcagtggaaagtagaactcaacacgggcttctacttctgcttctgcttctgcttctgcttctcaagtgaacacaaaaatgaaaaacctcactccaactttttcgatcctctcctgccgctgcagcacgatcttccttgcatcctaaatccgaaccgttgattattttgtatttcttgtttaattatgtgcaataattaatcaatggttgtgatttaacaaaattttggctccgtataaaattgggtagaaaatatctattttgcctgcttcttacctaaacttctaaggtgagccacatgtgcttcatgggcttgcttgctattggttgttattgctcccaacactcttgctattggtccttacaatataggcaagatatttttctctccaaaaatgtcatttttatagaatcatgatttccttattatacacatacaacataatcatatttttttacctccgaataacacaataaaaatatgtttacgttatgttataaaaaagaaaacatgttttgattgtattatgtataagggaaacatgattatattgtataacacacaggaaataaattttcaaatttaatttattttttatatttgaggtgttttaacgaaatagtgtttgtcgttaaatctctgcatcacggcgtgctgcgcagtcacacgttgacgcctgtctgtctcagcaagctcaccgacatcaccccttccattggaggttgcatccaatcacatatgatatcccttttcttgcaagccgtcaaaaatctgggaaaatataattgagagtaacaaatataaattacaaatttgaaagatcttaagaataaaaatcacatatgatatcccttttctttcattcttaaaactaatgttaacacaatcactaatgtactagtattttatttgcattttaaaaatattttaaaatagtactttgaagaaaaccgactctacaaattttttttttcaaaaaaaaatctcaaaagaatataaaaccatttatccgtgaaaaacattaggtaatttaattatcaattgtagtatatatgattttgggattaagatcttctgcctctatacaccagtaaattactgatgccaatgtggaagatattcttttgaaagcaatgtgaaagattttagacattaaaattatttaattttttgtataaaatactatacaattatgtctaaaaattataaatggatggaaagaatttaacttacactctctcgtcttaaattttaatggagaaaacttgtttccattgctttggatcgagttaactcacattgagagaagttttccatgttatattttgattttttttttatgcttttgtatctcttttattactattgcagtattactgttaaaattggcttagcttagatacttttctggttagtttgcaacaagaaggaaaaatttcgtttagctcttaatatttcgttgtgtactttgatcccaacatgtgtatcatgccatgactcatgagatgataacctgtttgcatagttttattttgatacaatttgtttaggctggcgaatccttatccttaatctcaagcattaaacacaacttaattaaacataattaatctatgtgatgaagatgcatggataagaacacacagaaaatattcactcattattatttgcaacatgaaacgcttgttccacatacattcaacaagccgttttatttccttttttcaagaagaaacttccaaacatccatccttttaattgtactattgtcccctttgccctgagcttacatgaacactgtaaaaagaaagaagaagaaaaaccaatgtcaatgaaaacaaaataactaatgatgactaattagtatgatggattaatttttactaagataaaaataaagttaaggaaataaaaagaaagcttacttgttacaattggtgttctgcttgctcatgataaaacccaaatcaacaccacataatttaggaagtgaacctgccctgttttctagcaaggaaggaaggcgaattgctacgtcgaaaaagcacttacatgcagccattcgttgaatttgtgttggtgctgatgttttcactgcattaacactttggcaacaaacacctgaagggataccatctccaccaatgaggtaatccacgcacgaaattaacaagttattcacttgtgaaccattgtagtcatttggtgctgaatttgttgtaattggtgcctctgaagctgtagcagctgtgagaacaaatacaactagaagagctaaaaatgtgacaaacactttcttcattttgtgaagctagtagtttctatatcaatgaactttatgggattaatttgcttgttttttatgggatgaattgaaggttgagaaatgtacgtgtgagctatatatagctacaaaagttgacgcaagcatgttcaagtggaatccacgtgatgtgctccaattgcaacaatttattaaagcatattaatgcatgagctagcaaacaaaagacaccgcttgatcaaatttgcatttaatgcgctgataaaataaatgcaattaatgtgaattcaagttctaagagaaatgacgcactgatcaaaaaaatttcaagattggctataaataaatgaataaacctgttttagactaagggtaaaatgatattttcattaaatacccatttattttccttttttttttcaaatcaaacatccgcaccaaatttagtttcactcttttctattttatttcactttaataaaaaaaaatattgatttacactttgtttcttatttatttgtctgcttttcttttctaactattcacttccattctttccattttcttcctcaccacaaaactcaatgataaggagtcactctcattaaaagtcattaaatatctaaattatatgaatttaacgttggagtagcgtaacttaataagcattaaattgttttattcttaaattaagagtcattaaatgaatatcttttttttatagagagtcattgaatatcctatcttaattaaatgaatagaaaaatagtgtcaacacactttcatttttttaaatgtcaataacacattttctaacacattctttataactcatattttattttattaaaatttatttaaaattataaaatttgaagagatattcattaaataagaaccgagacctgtaaaaattataatttttgataaattttaagtaataataaagtatattactaacatttttcattaattgaaattattttttgactttcaaataatgcaactttataaatataaaatcatttaaatttttgtgaaaatatatattattctaaaaaaattatccttacttcaattttgttgcatcagccatactcataaattatgagtatacattattccatttcatagtctatattttttttgaaagaaaaaaacttaattaattggatatcactaaagatatgttttttaaaataactattatgaaaaataaaaaatgtattatacataataatttattattagataatacttccttcgatctcaaaatctcaaatataagaaaataataattcatattaactaagaaaattaattaaccaatttaattatatcaatcttaattaattttttttcaatttactattcattggaacttggtattagaaataaaaaaaaataattgaagtatttttctcaatcttttgtttggacttattagattgaaatattttagcttctaaattgaagtattttgattggggtatttatggattttaagtattttaaataaattattgattagcacatttgttaaattttttattaaaaaaaaaaatctttgcaagtatccatgtattcccacaaatattgataaaatttgtgggtatagagagtatgagatggatttttactcaatggaattggtgacgaggactactacacgtttacatgtatcagtctcgctctaatgtcatccttaattcaaacaattaatttttttatctatttcttttttgcatcgttcttatttttatctgtcttgttttttcttcctattttatttttaatccaaactgagcactagtgtttggtttcttatgcctttaatctctcactccaagttcaaatgtttatgattttcctttgttttagttgttcttccatgatattctaaaggaagaaaaaataaaatttcatgccctaagcttaaagataaataaactttattagagttttaggtataattgatgttatatttccttagattggtttttagacacgttgtctagtttagtctcgtgttcttataatgatttgttttagtctttttcacatctcttatatttcctccgcttttctatagcagtacttctttgtaaatgttactcttgtatctatatttatattgtttttgctaaatgctaagcatatctaaattaatatttgaatgaccataattgattagtataacctccttaatcattagggtaacttttggaattcacgtaattgatcagttgtttgtctctaatcaattggatttttacaaaaaatccacttatgtttttctaaagaaaaaaaatacaataacagtataaaaattacttaacataatgctcaacgaaatgaataaatttagggcatatttatttaaacgcaaaattcattattttcattgtgacacctcttaatataaaatctatgactgaaactaatttagacatacatctcaattacattcagtaatttgaaattatttctgtcaaaatcaattctactcagttttaaaaccaactagtcttcattttgcatttcatagttaattcattgccttacattatgataaatcaacaaaagaagcccttggttgcccctgtcaatgcttgaaaaatggaaatatattcccataatctcaggagtaattggcacatgatccctgctgattgctgctaagctcagaacatggccaagggctaacttgatgagcaaatccagacacatcagaacacttccaaggtggagttctaggtcctgtcactccatgaaggttgatatcatataggcaaatatcagtgaaaggtgaatttctcaacccttgtatcaagccagcctgcaaaaccttcacaccccaaacattcttaattgtgacacccttcacaagtgggagagctttggcatcaaatttgtcatcagggtggtccccaacatcacctgagatccttattcccttccttgcttcctccatatacacatgagacatggttatattctttataaatccacccctgccagtgtttgtcttaatgtggataccaattcccatgttgtaaaggttgatgtgctcagcaagtacattctccaccccaccagaggtttcactgccaatagcaatcccagcaaatggagacgatccagttacacgccggatcgtgatgtcagagctaggacggccataagcaatcccatattcatcccatccactcttcacagccacaagatcatctccagtagatatgtatgaatcctctatgcacacatttgaacttgaatctgcataaacgaattgatatttgtatgaatggatatacaagggttcttttacttgtcataccaacaaaatggtgccataatatttcaaccaccagatgcctgtgggttttgcccttaaacaacagtatttaagtgttggtttattaactacgaaggaaagaaacataaatacagaactttagagtacttatcaaatttgagtgcagtttgtctccgaaatgaaacaagacatactgatcttagaagggaagaattactataaccaaaatgcattgcttacaacaataaaatgagatcagttagtaacttagcatagtgtttgactatttcaattggttgtatctatttcactatttgcacaagatatggcatatttagaagaggtgtactctctaacagtcattcttacaaactctattatcagttgaaatttattgaaattgtaaaattataagtgaaacttgttaaataagaagatagtctcataatttttaattttcaataaatttaaaaaaatgtgttgctagcctttctatatttagaaagcagttactacttacccggatcaatgccatcagtatttggagagtcacgaggagccaaaatcgtgacatatcgaacaacaacgttgctgcaaagaagttaagacaatatgcaatcagatttcagaatgagatctagttagtttaaagaaacaaagtaacaagtttataaagaattggtacaaatttgtttataaaattttcccacaaacattatggtaaaacaatgttaccaaagattaaataaaaaaaggacataaggaatgccatgaacacactttataaactccttatgacctaaagtggcatgcatatacctgctgtaaaccgggtgtatgttccaaaagggagaattcttaaagataacatttgaaataataatatctctagaattcacaaattcaactaggtttggtctggtaaactgaagagttccctgcctccacttattccaccacgcatctccttgcccatctattgtcccattttcacctatgaaaatatgaattgtgtgagagaaaggtatagtttggacacaaaatcctgtaaccataatagagaaactcgcaggatcaaagatttccactcaattatgaatatgcactatgcagtataaagcttggaataaataaaacatgcacagatattgtaaagcttttatcctttgtccatcatccaccaaacaatatacaagacaaaaaattgtcatgtaattcaagtatttgtcatgtgctgcacccttaggtgcatcaaacgcacctttaattaaatatgtttataaatattatcgtagtatactatgtggtctggtacaaaccacaaaatcagattagatgtcctaaaaaataggaaacataagatacccacctgtgattaccacatcctgaactccatcaccatggataaaactcatataccttcctccaggccgttcccttcctcttccataagatggcaagggtgcaatcaaaggccaattcaatgaatcctaatgaatcaaacaatgaagggaattaattagaaagtggagtccttgttcatctgaaacttatctatttgtttccttttttctctttaaacaataaaatgtttaagaaggaagaaacaaaggtgtttagctttaattgagcataccatgaaaacgttattcggatatgaatttattgtaatttttttatgtagataactacctggcgatgaattcattgtttttgggaataccaaggataaagaatgaagagttctgcattcatatgcaccatttcactaactatgatattcaaaataaatcaatttagcatagatataatcatcatcatcatctcagtttgtgttgtttaaccacacgaactatagtaacaaggtttaatgccagaagaataagtgagtaccccacttccacttgattatcaaagaaaaggacagtaattgtcagaaatccaagctgccatataaataattggctaaagccataaatgtcatgcacatagtgccatgcattgatgaagactagaccccccccccccccccccccccccnnnnnnnnnnnnnnnnnnnnnnnnnnnnnnnnnnnnnnnnnnnnnngagattatatgtttcccacgatccattacaatcatctatagtccatactccataccaccaatcatacggataaacacgtacatatatggactcaattcattggtataaccataagcttttaattgtaacatctttttttttatgcacgggaacatcagatgtacaatttcacatgtactctttaatgttcctttctctctttttcctctattctcctcgttatatttggtagtcggtgaagagtttgcgaacatgattttgcatagcaaggtttctataaggggaaaaccttatgcaaacttaactaagccaatcaaaaggttacatacaacagcaaacttaatccatgtcattaatataactttataattagcaagcattccgtacaaatatttcagcaaatacaggatatataaatagaattgtaaacaaaaggctcataattaaatcaaaataattggaattacacatgcgtcatatcatttttaaggaagagtagactaaaagagtaaatcacccgcaatatagtgtatctaatttaatagtatgaatttctatgtttcggggagaaaagttagcataaaaatgaatttgaaagtagctttaggaaaaaataatatagaaaaaattaagtattaataatatgacaatttttaaaggaaatttgattattttttaaacaattacaaacttgtctgtcttaaaaaagtacaataaaaaaaattatttcatttttaactcgagattgtaaatactactttattatatacgtattgataaaatacacagacaagataagattggctttgttgcatgatgctcaaatatgcacaatgtccacttacgggggaaagtgcaaacaaaaaataattaagcacgctagtaataaccttttccgacatgacaatcttttgcttgcatttgcataaaattccattgacttctctaataaatttactttatagtataaagtgagtaattttaactgttaacaagagaattaacgattaatatgatgtacaatacataataaatcatatatttatatttattaaatattacttactttactttcataaattatttccttaataacaatcaatcacactagaagatatttttttttacaaaacacacactagaagagttaaatctcataaattatttccttttataatacataataagttgattttagttaagaatttaatattaaaatttagggattggtaacaagttagagataaaaaaaatagaaaaacatttaattatagataacataaaaactaaaaagcactacattgaataaaaataataatgtttgttgtacaaggaattcaaaaaatattcaacagttcgtattttgggtagtgatttcgcagaagagtattaaaagacattggtaaaagaatcttcattctaattactcaaaaaaataagtacttaaataatttgcatgcttctaatgtaataaataaataaataaaaatttactaaacattatttttttttatcagaagaataaaagataaataacgaaaaatttacaataaactgtcatactttattgaaccaactaaaaattaaaccctattggtataatcatttattttaattattttctttatccactaaaggatactaaaatatattttgtaaaataattataaaaaatggtttggggcctttggggtgcgtttgtttacctgggtggccatgataacggcaccggcagcgagatacagcgtcatgtggctggtgaggttaaagggctccgttaagtacaccccgggaggcacataaaggagcgtgcctccttctcgtggcaagtgctgaaccctatatatggcctctctgaaggccttcgtgttgagggtgcgtccatcacccacgcctccaaactccgttatggaaatgttgtcggtgcggtgccccaactccactatgttcgaacacgacaccgtttcaccctcgcccaacactaataaccaacaacatgagaaaaacaccaacaacgctaacgttgagaatccgaggagcattttcccaaatcagaaatcagattcggagaaaccgaagaatgaaggagcgtggtggatatatcactgaatcagaatgaaggaaaaatgactctaaagttataagagcacttgatttgttttgttttgtttctagtactctgtagtacttagttggtgaaagcattaaactggtagtaatggtatggttctattgtgttgtgtcctcctactgagaaaaagaatctgctgtaaagttgtgtatatgataataaatgaaatcagatggaggaccacataaaattatataatacatattgcatatttctcttccctttattaattattcttgttttgccttgcttaatgtgaaattgtgtgatgaatgataattagtactagttacagatgtctttcaaaaaaattaatagagacaaattgaaattgaaaagttaataaaacagacatggtcacatgggtatatatatatatgtatgtaaaggtatttaagtaatttcatctatataagcagtacatgggtacattgatatccactcccatctttctaataaacaggtagagtaaaaaaaagttgtttaaattagtcatgagtgttaatttgactatccaattcgatttgttatgaagttaactcgtatttggggatgcgtatatggatatagattctttgattgttttgttaagcctgcaaatcttatggataatagaacctatttttctaaagtttgaatttaatgagttctgaatctggcctgttaagtttatagatctgatagactttattcgtgaattactcattactcatttaatatgattaatttgttatgttaagattgtgatctttaatttaggttattactattaatttgttatatttaaaatattggtatattgtagtataatagattttaacttaaaaaataaatcaatgtttttctaattttatacatttttcattttataaaaattatttttttaaattactatttgagttcacaaattgatttgtttattcgcaagtttttgcgggtggaatacataccttgaaaaaatgtttatttacatcatagatcaagcttatatgcccatctaaaataggggctttgtaggccagatcggtctttataccaaccctaatcgtatgtatctgcaaacatttgtcacccctagtttggatggataatgttgtgattctatccaaggagttggtgaaatatcaacagtggttgatgcacaaagaattcaagtaaatattctggccaatgatgacgatttctgacaaggtgagagacctgcaatcacttgcacaaaacactttgatgctaaagtcaaatagtgtatggagatgtgtaaaataaagttagctttttacttgtaggaatgaaatgtgacatgtgacaagcccgaatgagatctataatagttgtctttaagtcaatgttgctaagaataactaacttagacttaagatataaagcgattttaaatattacattcataacaaatacgatagtatctgttttcatacacatttaaaaaaaatacttacacatgctctcatacccaaatggatagcaacttttggcttcattctcatatatgttggatatccatatattcataccctcacttactacccgttctttattaatattataaagccaataaattattagaaaaatactagttaagaaattactacaataaatttatatccttccaatgtatttgtagttatttcaatgtatgaattggtatgaaagttaaaagtaacattacacaaagctatttgtatgaaatttatactattataaaatattaacattatggaagttttaatggaaaatagcttgatatgatatcttgacaaaaatttacacgcttgaaggtaaaaaggcaaacacgatttatctgtaacatttgtttaagcacgtgacagtaaaattgctcgacattacgtctgtgaaaggaaatcagggttccctgtgcttgcattaaattataattaatatatatatatatatatatatatatgtgtgagattattcacatatataagatattttaattaaattaattcatataataggtaaaggataggtaagggatggttactgagagtatttatacttacaatcgcgtttgttaaaaaattatagacaaacatacacatcgaactcatccccaaacatatatttattctatccatttacaaatatttttattggtacatatagggtcttggcaccctttatcatccctaataagataataacttatttcacttaattttattttgatataagttgtttaggttcttagatcattatccttaatatcaagcattaaacaaaaatgatttaacctaattgaacacaattaatctgtgatgaaaatgtatggacaagaacacctaaatttgtttcattaattattatttgcaacatcaaatgtttgtttcacatatgttatacaagttgttgtttttttggaagaaagcaacttcaaagcatccatcctttttattatactattttctcctttgccctaataatgagcttaaaaaagttttcatcctaaagttgtaactggtgcccttggcggccctgccttcggtgggcccaaatttgtaattggtgtccttggcggccctacctttggtgggcccgaatttgtaattggttcccttggtggcccttccttgggtggtcctgaagttgtaattggtgctcttggtggccctgcttttgatggtcctaaaggtgtagctggtggctctggctctgaagctgtaactagtggctctggttctaaagctgtaactggtggctttgactttgaagttgtaattggtgcccttggcggccctgcctttggtggcccagaagttgtaattggtgcacttggcggtcctgcctttggtggcccgaaagttgtaattggtgcccttggtagtcctgcctttggtggccctgaagttgtaattggtgcccttggtggtccttcctttggtggtcctgaagttgtaattggtgctcttggtggccctgcttttggtggtcctaaaggtataattggtggctctggctctaaagctgtaacgggtggctctggctctgaagctgtaactgtaagaacaaatacaaccattagaggaaaaattgctacaaacactttcttcatgttgtaaagctaatttttatctcaataaactctctaggatacacttgtattttgatgggaatgaatagaaggttgaaagaggtatcatctatatagctacaaatgtggtacattgaccaccttaatgacgtaaggtgtggttatgaaagattggcttcttattattaattttgcttggagtgtgttccttggaatcacaaaaaatgataaaatattaattgtatattgttcatttcctaatattgctttaataactttaaattgttgtgatgacgtcaaaatttatgtttgtttcatgcatttaatttatcacatttttttacaaaatatatactaaaatataaaacgttaaaaaaatattaccaatataaaattttaatttatccttatgtaacgtttttttttcttctcaaactatactaaaaatattggggaaaaagtttcttaatactaaaaaaatgaattatttttatctggttctattcgcatgagtttttttatattttaaattataataattagatgatgaataaattaaaagagcacattgcttttaatatttaattttttagttttgttaaagatatcgataatatataaaatatattgaaacattatatgtgctaaattgctaaaatacaaactttattctcatattaaaagtcattcagcaatatgcatgactctattgtaatttttttggtatttgaatttgatttatacatataaaatattaagagtcattgagtatcttaattaaataacaaataaaaagtgatagtaacacattttctaagacattttattattatttgactaacatttattaataatatatataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttcttttaatttcttaacttatactctaaaaacactgcttagtaataccttaatagcctataacaatttaatgtttattatgttgcactactccaaagtcaaaaagtggtttctattcatttaattgagatattttatgatctttaatttgagaataaaatattttttatatttatgtctcataaatgaaaaaaaaatatttaaagttttttttataaatataaatcgtcacctgttttgctccaaaatatgtgagaaattaaacgcgtaataaattctaacgcaaacaaaattaaaaaccattaaaaataaatacatgtccaaggatctaactaaaaaaaataaaaacctaattataaattatgaaatagtttaagaacctgcaaattaatacaaacttcaattcattcaatattttttttttcacaaaatgactcttaatttgaaaataaaatagtaaaatactagtaatgaatatattcaataattctcaattttcaaaatataacaaggtttattgctgcgcaggttgcactactccaaagtcaaaaagtagttctattgaaaaagtagttctattgacttaattgagatattcagtgaactttaatttgagaatataagtcaataaattattagaaaaatactagttaagaaattattacaataaatttatatccttccaatgtatttgtagttatttcaatgtatgaattggtatgaaagttaaagtagcattacacaaggctatttatgtaaaatttacactgttataaaatattcacattatgaatagttttaatggaacatagcttgatatgattatcttgacaaaaatttacacacttgacgataaaaaggcaaacacgctttattcttaacatttgtttaagcacttgacaatagaattgatcgacattacgtctccgaaaggaaaccaaggtttcatgtgcttgtcattaaattatatatatatatatatatatatatatatatatatatatatatatgtgtgtgtatgattattcacatatatagaatattttaattgtattaatgcatataataggtaaggtagggttactagagtatttatacccattcttaaaaaattataaataaacatacattccaaacttattctgaataaacatgtatttattttacccatttgcagatatttttgttggtacatataagattttggtaccctttatcatccctaataatatgataacttatttcacttagttttatttgatataaattgtttaagttattagatcattatctttaatctcaaacattaaataaaaatgatttaacctaattgaacataattaatctatgtgatgaaaatgtatggacaagaacacctaaattttttcattgattattatttgcaaaatcaaatgtttgtttcacatatattagacaagttgttgtttttaggaagaaaacaacttcaaagcattcatattttttattgtactattttctcttttgcctttattcatgagcttaaagttttcatcttgaaattgtaattggtgcccttgtcggccctgtctttgatggccctcaagttgtaattggtgcccttggcggtcctgtctttggtggccctgaaattgtaattggtgcccttggcggtcctgaagttgtaattggtgctcttggtggccctaaaggtataattggtggctctggctctgaagctgtaacgggtggctctggccctgaagctataactggtggctttggctctgaagctgtaactgtaagaacaaatacaaccattagagaaaaaattgttacaaacactttcttcattttgtaaagctaatttttatctcaataaactctatagcatagacttgtattttgaagggaatgaataaaaggttgaaagaggtatcatctatatagttaaaaatgtgggacattgaccaccttagtgaggtaaggtgtggttataaaagattgacttcttattattaattttacttggagtgatagagctaaaaaaatggcgaaacattaattgcatattgttcatttccacatattactttaataactttaaattgtgatgaagtcagagtttatgtttgtttcatgcatttaatcttatcccatttgtttgcacaaaatatatactaaaatataaaaataaaaaaataaaaaataaatataaaaatttattatcaatatgaaatttaaatttatctttatgtaatgttttttttctcaaactatactaaaaatattgggggaaaagtttcttaatactacaaaaaatttaaattatgtttatctagttcttttcacatgagtttttttattattttaaattataataattaaataataaataaattaaaagaacacattgcttttaatatttgattttttaaattttgttaaagatattgataatatataaaagatattcaaacattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttgagaataaaataattgttatatttatgtctcataaatgaaaaaaatattcaagtttttaaaaatataaatcatcatctgttttgcaccaaaatatgtgagaaattaaatgcgtaataaattctaaagcaaacaaaattcaaaaccattaaaaaataaatacatgttcaaggatctaactaaaaaaaattaagaatctaattataaattatgaaatagtttaaggacctgcaaattaatataactgtcaattttattcaatgattttttttcacacagtgactcttaatttgaaaataaaatagtaaaatactagcaatgaatatattcaataattcttaatttcaaaataaaacaagtttatgtttattgctacgcaggttgcactactccaaagtcaaaaagtagttctattgacttatatgagatattcagctttaatttgagaataaaataattgttatatttaagtttcataaatgaaaaataaaatatatttttttaaagataaattatcatttgttttgcaccaacggctgtgaaaaattaaattcccaaaacaaacataaattctaatgctatcacaattcaaaaccattaaagcaaagtacaacctatactttaccattttctatggtctatctaaaccacactccaaatattaaaaaaaataaataagaaatcaaaattcataaccactgctcacatcatcaaggttgacaaatgtaccacatttgtaattatataatgaacatctccctcaaccatttcatccatccacatcaaaacacaagtgaatcctagaaaagttcattgaaaaatagaaactatcttcacaaaatgaagaaagtgtctgtagcattcttaactctgcaagttgtattagtccttacaattatagcagcagagccagcagggaagggctacaattgtgaaaaggcaaaaagctcagtgacaccgtgcataaaatacctcactagtaaagttgataccccttcagctgcatgttgcaatggtgtcaaggaagtgaaatcatcagcaccaacaaaagatgaaaaaattgctgcatgtcagtgccttgaagaagtaacaactcacattcctaacttaaaggaagacagagccactgcacttcctaaacaatgtggtgttgatgtgggttttcccatcaccaagaacttcaattgtagcaggtaaactttattttatttttatttttttttacttttttttgttaaaatattaatctatacatattaatacccatcattattttactttcattgatatttttttacttcaattgtagcattgcttgagcaaatggcagaggaggaaatagtacattaaaaaggagggatgcttgcaagtagttttcttgtaaaaaataaaatagtttgttgaatttatgtggaacaagcatttaatgattaatgactatttccatttgttcttatccacacatcttcgtcatagagattaattgtgcttaattaaaatgaataatttgtattcaatgcttgagattaaggattcaccagcctaaataaattagttaaaaatgaaatcatgcaaaagtaagttatcatctcatgatacgtatgttgggattataatagtacgcaataaaatattaaaatcttaaaaactctccttttcttatggcaacctaactaaaaaaaataatctagcgaagttaatttcaacaatgatagccataaaaaaatgggaaagcaaaataagaagacatcaaaatttaatgtggaaaactttccttgatttgagagaataaaaattacatgatctaatctaaaatatttttcacaatataaaataaacttaatcccacatttgatacttaacaacacttttgattccttaattttcggaaatgtgcaattttgatatctaacttttaactgtacaatttgggcctcgattttttcaagtaacaattaagtccctccatcaatgtgttgcccatttttatttaattttatttttattgatgtgatttgtctaaacggtgttatcaaagaatgaataagacttaaaataaattttgaatgagaccttttattactttaaattagattatatattagatatttttgttaacatatgacctttttattttatcaaaaaaactaatagccaaaaaaagtctataaaaagtttgatgcattgcattttaattaaactagtgtaataagttgtatcatacacaaatataaaatttatgatttataattttttatattatatggtttttaatatacatatctattattttttaatttataaaaaatgtaaacatgtagccaaagtatgtgtgtgaatattaatgtaagattagtgtattagaaataaaaagtctattataaatattttttttatctattattttatattttaatgtttgctcgtttttaaaagtaggtgttgacaatcaccaaacactgaattactctcaataaacacttaattatcgaattagagtcttaaaatgcaacaactatgttaaacatctatagggagattttttttgttgtctataatgattatgcgaatacgattgtttcccattggaacagaccaaacttggcaattctttgggttcgagaccaaaaccatagtatccaatgagtatctatctacgaaaaagcgtagaaacgttccgtatttttcttcgtcgttatcgtttcgtataatagcacaacacataccatgccatggatcaattattaccagtcactgtgcattattgttgttgagtaacatagccattagccatatctctctcccatcacattctccgcttcttccactgaaatcccacatgaatgtcactctcacttcactcgcctctctcccccaatccctctgattccactgttcagctccgctacggtgagatctgggaagctagggtttgaacttcaggctcccaattagggttggattcgagcgtgttatgagaaccaggagattaagggtgttgcattggaagtggctttggatgatggttttctgtgggtagcttcaattttcggggtggggtggggggtggggtgggttatgaaataggatcatttctgattcaaaggggcatgcaaaatttgcgacctttataacaataataatgcttttattcgacttggggtgcttcagtttttactagtttggaacttcacctattgttatagctccaagcatgaagctctcttcttctggatttaacccacctgctgaagaagaaggtagcagtggaagtagcttctttgattctttcattttgtgcaaattgctttgtattttgctgcttgccctgctcccactttttgaaagtttcttatctcttgtcttttccttggtttgttggtgtagttgtgttttttgtgttggtagttctttttgtctttgcatgtgtttggaggtaggggttaaggatactctagtagtactttaacttgtaggggttggtttggcattattatatggcatggagtgaggttgaacaagttgccatagtttgtttttgtttgtttataatatgtatttatgtcagggtcaacttcttagtgtcatgtggatttgatttgtgtttgatttgtttcaacttcttatgtgacaaggttgtattgtgtgttactatttatgtgtggttattctgtttgcctgtttgtttttgtgattggagttcggattgtggtatgttttttttttttttttggtaaaatatgcagtggatttaatgagtttattactgatatgccacttgtagactgggctaaggcgtggtgcccttttgactcgtgtgaaatgatttacttcatgtttattcatattagcctgtgattgtgtaggggagaaaaaatgtttgaattctgaactttggcatgcttgtgctggccctctggtttctctgcctctggttggaagtcgtgtagtgtactttccccaaggtcatagtgagcaggtaagtaatgcttcttgtatcctataagttggatttattgcactatgcttgaatttttcgcatttcatggatatttggtgaagttgctatgctcatgaaaagtacataaagtcgtatagaaaattagaagctcatttagtatatctatatgatcacggtgagcaggacagttgtaatattttgatctgtctgccaaagttagtggagtagacttcaacttattgtttcttgtatgtgtatggtgaaatcagtcatgcttgggctagtgcaagctcatagttttaagataagattgatttggtatttgaactgataggactgggatttacaattgtctgcagtactgtgaaaatatggagatttaagcagtaagttacatgttagcagacttcatggattagtgtttaagttgttgtgcctggagggagggaggatgggctaattaagtgaagagaaaataaaatatgctccaataaacgtttgatttaggctttctgttgttgttgctaacattctagctcataagtgaagtccctagtaacagatatgacattgcttcattcttgaaatgagcagcattttgttaaattttaaatagaaattgtggcattaaggtttctgttctagaatagtctgagctttgatcagtctgattatcacggtataaatcttatctataattactatgctaaaaatgagtgactgacagatagagaactctttattgcatcattatggttattttcagtttcaatttttttccccggggcaggggagggggttcaagccaaatggttctaatctattgttgttgcatttgaaatttccaaataactgattgcttttcatatatttcatttatatttggttcttcagttatttgatagatgttgatgtttatgttacaggttgctgcatcaaccaacagggaagtagatgcacatattcctaattaccctaacttgccaccacaacttatctgtcagcttcacaatgtgacaatgcatgtaagaataaaattaatagttgagaatttcagaaaacatttttatgggcttgcgctctgaaccttttaagcatgcaccttgcaggcagatgctgaaacagatgaagtatatgctcaaatgactctgcaacctctaagtccagtacttttctcttatttgctacctttttctattttttttttttttttttttatagcatatnnnnnnnnnnnnnnnnnnnnnnnnnnnnnnnagcaaaaggaggtgtatctgctgcctgcagagttgggtactcccagcaagcaaccaaccaactacttctgcaaaacattaactgcaagtgataccagcactcatggaggattttctgttcctcgaagagcagctgaaaaagtcttccctcctcttgtaagtcatttatctgttatatttggttcacagtaattagtttgtcagctcttgatctgactgatgtgtttctttaatttgtttctcaggattactcacagcagcctcctgctcaagaactaattgccagagatcttcatgataatgaatggaaattcaggcatatatttcgtggttagtttttttttttttttttaatttttggtataaaattatttgtggtccttgcatctgcttctttatgtccagtttatgctgtcgcactcaatttcttgtaaagaaaagcacatctgatgatattctataaacttaaatctgggatcttcctttttatcattcaaaacattaaaattggagtagcatttgaagcaggacatagttttctaaggagtaatttaattgcgtattatatgactatagtagatgtactattttacttctgtcttattgcagactcatttcatccttatttgattcgctgcttgacttactttgtttggccattttcttttcttgtgttaaactttagtcaaccttggtcattttctttactcatactacatttaaaatagcattactgttgtaatttttaatttttagtcaaccttggccaatctaatttttgttttgcatgaacagtatgagagctgtgttaaggatcattatattgttgagtgtatagtccttaatcatatacatcttatctttggctcttcctttcctcctgaagatccttttccatatcaagtttgataaattgtctatagtgaaaccaaggaatgattagcaagcaacagtcgtgatatgtggtgtcatgaaaaagctgcttaaattgttacttaaatgttttcacttctaactgcttcatattttcactttcaggtcagcccaaaaggcatcttcttactacagggtggagtgtctttgtcagtgcgaagaggcttgttgctggtgattcagtgcttttcatctggtacatgtaatttttgatatttccattaaattgacctattggagattcaactccttttccctccctctatcttcgaacacagttttagttatagatatatttattatggatatatttaagcagaaagaaaattacaagaggactttagactagaagtcatgttatatttatattagttcacattatttcaaaataatgtatctgtgggagctttttgacctgataaatatgttttagcttgttaccctgcccgtatagaaatatcgtcggtaattgcatctatataggccacgggtgcatgattgaaatctattcaaatgaactataagatattattgtaattcttcttcttcttcttctttttattaggaatgaaaaaaaccagttactcttgggcatacggcgggcgaatcgtccgcagactatcatgccatcatcggttctgtcaagtgatagcatgcacattggtcttcttgctgctgcagctcatgcagctgccacaaacagccgctttactatattctataatcctaggtgtgtaactttaatgctaatgctaatgatgagaattatcaccctacaaatcacactgaacatgctctccccccctctaattttatagggcaagcccatctgaatttgtcattcctttggccaagtacgttaaagctgtgtatcatacacgagtttctgttggcatgcgatttaggatgctctttgagacagaagaatcaagtgttcgtcggtaggtatttattgtcttaaattttcctttctcttgtcactatttgggccttgctcgaagaagaaactcaaggaggacaaaaaattcttctcccatgtcaatcttagtgtttactttatacttttgtctgatgacttagagagacagttgatttggttaaattacttcttaggtccctgtactttttgaaaaaattcaaaatggtcttttgatagtttgaaattttaaagtttcctttttgtaaatagccccctatgaccctctaatggtagtgtggattcgaggactcttaatttttttttggaaactataggaatccaacccagttgctaattcaaactatagggataactgagttctctctcaaaaaaaagtataagagacctatgaagtaatttaacttttttttttttggttacaaatttaacctttaattttactttccaaatttatttatgttcctctttaaatgtggtttatcaatgaatgtgtggtgataaccacatagtactttgggttgggtgtgcagtgttctgtgtcgtatcaatgaagaaacaaatatgttgctattcacagaacactgcaattcccaatcagcaatgcgggtaactgcacatgattccatcccaactttaacagtgaaagtattagttggacccctttaaatctttatctgtgtgtgactgtgacttcaacagttgtgtcagtagcaagtcgatcttgtttccctttagctttcctcaattttggttcctgccattttatgttactgatttgttggtttctaaccattattattgtattaataattttctgtatgccatttaatgccactctctgctgtgcacttcttttcatgactgttgatgcattacttatgtgcttccaaaagataaaaagccaaaatttttgtgactgattagccatgacaatatatgcttgtatccttccaaaagataaaagctttggatgtttagccacgacaatatttgcttgtcctttagaacagtggtctgttctaagttttttttttccttttttttttttttttttnnnnnnnnnnnnnnnnnnnnnnnnnnnnnnnnnnnnnacatgggtaccataactggtattagtgatttagatccagtccgctggccaaattcacactggcgttctgtgaaggtttgttatgactgtttgattcatatagcaactatatggcattgtcatgatagaatttagcaatattatagaaatatcagagattgtgtttacagataaatgagatgatgtataatttggttttttaacttttgtctatgggtgtaggttggctgggatgagtccactgcaggggagaggcagccaagagtttccttgtgggagattgaacctttgacaacattcccaatgtatccatctccattccccttaaggttgaggcgcccttggccatcgggcttaccttctttatatggtatgggtggttttgttaagtgtcatggcattctatgggatctgtgacaatatgcttgttttattttttgtcgtgaagtacatgacatcttcaccttaatatatttcttccttccttttgtgtaagtcaggtctcaaggatggagacatgggcattggttctccattcatgtggctccaaggtgggcttggggatcaaggaatgcaatctttaaacttccaggggcttggtgttacaccatggatgcaacctagatttgatgcttctataccaggtctccaaccagagttataccaagcaatgacttcaaatgttcccagtgctcatgcttctgaggtacagaggcaagtattaccacaggctcagcctcaaaacacccttctacacaattttcaagaaaaccaggtgcctgcacagtcacaacttctgcaacaacagttacatcgttaccacccttatagtgatcagcggcaacagcagcagcaacttaaaaacttgcctgttcagcagttaccaaatgtcatctctcctttgtccaattttgcatcaggtacccagtctcaatctcctcccatgcaagccctagcttcacattgccagcagcagagctttcctgaacctatgaggaatcatatttctggttctgatgtttcccctatccagagtctactagggtcattctcccaggatggaacatcccagttacttaacttgagtggatccaattccgttatgtcttctgcagccatgctacccaagcaaataaccgctgaacctcctcagcttccatctgctgcttctcagtgcgtattgcctcaggtggaaaacttgggaacatcacaatcaaatgtgtctgaacttgctgctttgcctccatttcctggaagagaacattctgcataccatgctgctgatcctcagagcaatcttttatttgggattaacattgacccctcttctcttatgctgcaaaatggcatctcaaacctgagaaatataggcaatgtgaacgattcattatcgttgccattttctgcttcaaattgtggtggtgcttcagtcactgatttccccttaagttcaaacatgacaacttcgagttgtgtggatgaatcaggtttcttgcagtcttctgaaaatgtagaccaagcaaatacaccaactggaacctttgttaaggtaatagctaatgccttttgtttataggtagtatgcctttatttatgtattttatgcggagccacttttgaatatcatttaccaaaattaagcaacagtttattagttaaagaataggttcaaggtacaagttaaatatatttatataatatatttatcttcaatgttgaattggttctgttgtacggggatatttgggaccctatttttatataaagagcatattgcagctactttttatttttgtttcctcttttttgtaggactactattttctccaattagtaagtggatgttgtctactgtctaggactattcctattattctaattttatatggtgatggatgtggtgtaattttgacaggttcacaagtcagggtcctttggcaggtcactggacatttccaagttcagcagctatgatgagctcattagtgagcttgctcgcatgttcagccttgaaggccaactagaagaccctaagactcagagatcaggctggcagcttgtatttgttgaccgggagaatgatgttcttcttcttggtgatgatccttggcagtaagttgccatatgccagctgttatttacgttccaagttataatatactatcttgggatttgctacatccttcattgttgctaatgtcattgacgctataggaatagtcagtaatgtttcttacatatttgataatttgaacatgttgacatttcacaaattttttattttatgggtctgaataattatttgtaccatttttcttgttccttctattaagtttttgctcactaactttgagtataggttcattgctttgagattactgaaatcatagtccacgccgaagagtatttaattactggcgcatgtcatcccaagtagtaaaaggctagaagaacgatgcttgactaaaaaatgaatatatagccaagaagcacatcattttagactttcctgattctgcacagaaatatttacatttgataattttgcagggagtttgtgaacaatgtgtggtacataaaaatactctctccactagaagtgcaacaaatgggcaaaggtcttagtccttctacttctgctccaggtaacaaactttctactcctgccaactcttgtgataattatgtgagtcaacaagagttgagaagttcgagaaatggcatggcatcaatgggatcttttcactactaggacactctcccatgtaaggaatattagttgaaaaattatggtggcagaattttatgttacaagttttcttatgtatggattggcccagcattcttatacacattaatggttgacatgtagtgattttgcaaggtctaaatagatcaacagcaaatgactgtaaattataataggtgacctcgtttctgtaatggttagttgcttatagcagttattaattattactgtatctcttatttagttttgcaatcgaaaatttgggagcttcgttgttgatccattttcttttatacgcacgcaccaattttccatcatatttgacaaacggtccctactgacaacgtttcaaaatcgacaaataaaatgtttctgatgaaaaataatttcatttaagcaatatatattgtaataaagaatatttcaaatggtttttttggagttgtcaaatataaagtttctgcagttcgaggcttcaagcataggttaatactttaaaaaagttaatttaacttgcgtacagtttttcgtttaaaaacaacaaaaaaacttatgaaaatactagtatgaaagaagttttttttccccctcttttaaaggtgcttaaaaagttttttcaattttctttcagtcgaaaaaaaggtttattcaaatagtgctaaattatttttacaacctctattcattcactttttcttttgaagttaaatatttgattcgctaaactgaacgacataattataaatgttccatgttaaaaatggaacatttatagttttttttatttcatgatttataattctaattattttttgtttttttttcaaatttatttgttaattttagttttaaaattaattttatttaataattagcccaacttatttctttctcaaccatctcaaatcatctttaatctatgtaattgattttgttaaccactttcaagtaactccctctttatctgtatacaaatatatttgatttttttaactacttttttatctttatttttaaattgactttaatagtttttttctttaaaatatcaaataattacaaataattttatattaaaatattaaatatttatctaaatttaaaatacaatttatttatttcagatgatgttaaaataaattcatatatttaaaactatttattcattgcataaaaaaaaaaaaaaactaaaacctgtgaagaatctaacttaattcaacaaatgcgtgagttactataaaaaaaaaaaaaannnnnnnnnnnnnnnnnnnnnnnnnnnnnnnnnnnnnnnnnnnnnnnnnnnnnntttgaagtttcaagtttggacgctcgtagtctgcgtttaaacgtggaacctaacaaacatcgcctccctcctctcatcgtaacaaacaaacgcggttggactttggacatgtgtgtttcaattttcattgacaacaaggagggtgcactgtagcatctgtttcttcgtttattgcgccccacgtcgcggtggctccattggggttagtttctctcaccttcatgttgaaaacattaaaatcctcaatccatgtcaatagaaccaagctagtttgcttcaaaatcccttctttcccactttccaccactgccactggtaccaatttcaatgataacaatgaacctgagagtagtagtgacacagagacagagtgggagagattgctcaaaccctttgacctcaaacggcttagaagatcactcaccccaattagcccattccagctttgtaaattgttggagctccctcttgacattcccacttccatggaactgtttcaaagggctggtgcccaaaaggggtattgtcacacctttgatgcatactatctcttaattgataagcttggggctgttggggacttcaaaattatcgaaaagttgttgaagcaaatgaaagatgaaggagttgtttttaaagaatcactctttatattgattatgaagtattatgggaaggctggattgcctgggcaagcaactaggcttttgttggacatgtggggtgtttattcctgtgatcccacatttaagtcctacaatgttgtgttggatattctagttgacggagattgccccagggtggcacctaatgttttctatgacatgttgagtagaggtgtttctccaactgtgtacacgtttggggtggtcatgaaagccttgtgtatggttaatgaggttgattcggcttgctcacttctcaaggacatggtgaagcacgggtgtgttccgaattcggtcatttaccagaacctgatccatgctctttgtgaaaacaacagagtgagtgaagcgattcggcttttggaggacatgtttctgatgtgctgtgagcctgatgttcagaccttcaatgatgtcatccatggcctctgcagggctggtcggattcacgaggcagcaaagttgcttgatcgaatgctacttcgaggtttcagcactgatgctttaacgtatggatatttaatgcatgggttgtgcagaatggggcaagttgatgaagcaagggcgttgctgaacaaaattcccaaccccaatactgtgctctataatacattaattagtggttatgttgctagtggaaggtttgaagaagccaaggatcttctgtacaataacatggtaattgcaggttacgagcctgatgcctacacgtttaacataatgatggatggactagtcaagaaagggcatttggtctctgctcttgaattcttctatgatatggtagcaaaaggctttgagccaaatgtgatcacatacacaatattgataaatggtttctgcaagcaaggacgattagaggaagctgctgatattgtgaatagcatgtcagcaaagggtatgagtctgaatacagtagggtacaattgcttgatttgtgcactgtgcaaggacgggaagattgaagaagctttacagatgtttggtgaaatgtcaagcaaaggatgtaaacctgacatttatacatttaattctttaataaatggactttgcaagaatgataagatggaagaggccttgagtttatatcatgacatgttcttggagggtgttattgccaacactgtaacatacaacacgttggttcatgcatttcttatgagagattcagttcaacaagcatttaagcttgttgatgaaatgatatttagagggtgtcctctcgacaatattacatataatggccttatcaaagctctctgtaaaactggggcagttgaaaaaggattgggattgtttgaagaaatgcttgggaaaggggtttttcctactattgtctcttgcaatatactgatcagtggcttgtgtagaattgggaaagtaaatgacgctctaaaatttcttcgggatatgattcatcgtggtttgactccagatatagtcacttataacagcctgatcaatggtctttgcaagatgggtcatgttcaagaggcagcaaacctttttaacaggttacagagtgaaggaattcgtcctgatgctatttcatataacacactgatcagtaggcactgtcatgagggtatgtttaatgatgcgtgcctgcttttatataaaggcatagataatgggttcattcctaatgaagtcacttggttgatactgataaattatcttgtgaaaaaaataccacggggagcaagaatttctaaggattttatggtggaatttggagtttcttttccttgaagccaacttattctttccagtcttgatcttatttgatttgtctgttggcatcctgattatgagctaatgttggctaagaattttggtccatttgctatgctcatgggaaattgggactccaacattgtgaattgtttttaagatttgtggattgttattgctggttggacttggagtttacacaagtgcagaatggggaaagactattttgagttatatcatcaaactggtcaaagttttctgtagttgaagcataaatatgtatatatccgtagagagaaagataggtgtggctggttccactgctcgttaagaggtaaccaactattgtcttgccatgttgaactgtctcccctcagattgattgatatgatttttttttaaaaaaaaaactatgacatgtttgttgtttgtcctcatctccttctctggttacttggttggcttgatatgattgtgaaactgagcttttagacataatggtgggctttggttttagttttgtttttttttctgtatttgtagcttgtgcttatgttgcagttggtttgagctttggtgttttttgttgtaggaacaattcctggttggggtggataagaaatcacagggttggtgattggttgttcccctgaaatggcttgaattataacggccaagggaactggtgtgatagaaggaactgtcagatgaactggtgggggaaattgacagaattggcggaaggaactgtgataatggttggtgtatctggaggtttcatgactggtgtaggtgggcttgaatttgcaaggaaaactgtggtaggtgagttgtttggagatcttgctttgtggaagaatggggcaccaaccgatgatgaggagagggtgttactagaaaataggaaatttgagtaaaacagagtcaaagacagcattccacaatgcagaacatggacgtcgttgtaatataccataccactatatcaataattagtttgattttactccgatataaaggtaagcacactgacataaaagaaagagcagggttgctgtgaactcagtgatttgtgagctcttctgtgtctccttatctcttctgtctgtcagtatctctttaaaaaaaaactcgttgcttttatctttacacacaagtatgtcatgtttaacaaagaaattttacccttactcagagtcagttatgatttgtttagtcgttaatgatgatatggcattaatttaattgctattttattacattttgtggcgcatcacaaagatccaacataatccccaaatcaacaaccctttctcctttcttctttgccactcccaatttctctatgtctacactgaaaatgaactcaagttgatgctcctccttaattctatttttttcctgctttgttgtcctctttaaccaacgttctaaccttttcctgaacctgacaaaggctctgcagttgttttttttttttttttaataactcttcccaaggtcaaagaaaaaacgaatcaaaatattttattgtttaggttatggcaaattgataatatatatgtactacacaaacaacaaaatcttttgatttattttttctttgaccttcagaagagttattcaaaataagcgatgatagagtcctcgtgaagttcagggaagggaaagaatgtggttgaagaagacaaaaagcagaaaaagaaattagaactaaggaggagttgcaaattgagtccatgctcaatgtaagcattgtgaaattgggagtgatagagaaaataaggttgttgatttgaggaatttttatttatttatttgggaattgtgtataatctttgtgtttttattggggaaaaaatgtgatcaaggggaaagatcactaaaagtgtctagtcaaagtcaagtgtttaagcaaaaatcagtcactaattaagccaatgaatacttcgtatttgtaatatggtgacccaaaataatcattcataaacgatctagcatgtggatcaattgatatatagttgttctaccttaattatggtcttaagtttgagtttgtcttaaatacttgaagagaaagcttgtcacttatagttatcctatcctccttgggcaaatatcgtttgagttaaaggatacatgctgtctctagcaaaaaaaaaaaaaaaaattataaaatttgatttgacatgcaaaagattcaataaaactaataatctttgattcacatttctccctaatgatgaagggtttgggtaatatatataagtactcatctttgattcacatttctcccattataaaaaaaaagtacatataaaaaaaatttgaattataattcaattttgttgataaatgcattaaatatgtttctttgaattgaaatggtaaaattgttagttatgaatgtaccattcaatattttgattcactcgactatattaataaaatacaataactatcaaatttttagtcaaatcaaataatttttttttttatcaatgcacattttttttcctccttttttgtatttttacatttacttttattttcctacaggaaaatatccatggagaattggacaaaattgcacaattaatatgtattcaaatgtatattaatagttataactttttcaaatcttaattaatataatcaatacaaatatgaaataaccaatttaatatatttttttatttatgcacaacaatttaattaaataaatgttagaagatctatctgatatgttaattaatgaatgttatgacaataaatttattttaaaaatttcaatggtactttatttgaccgaaaaagaggcttatggcattccactcataataataaaatcaatataagatggtaaatactcaaaattttttgggattcgatgaaacttaaacgcccttgcaaaagcgacttggttgactatctcttgataaaacaaaaaccataacgttttgacagaatctaagtaaggttatacaaattgtcacaatagaaacaaatttaagattgttatgagatagaacatcaactaattgcttgtaatctaattcaatattcacatttagtgacttcataaaatcaatccacttaagaataagtagaagtgcagtagcctatgaaaaaatggtccttatctctaaacccatgattattccaaacatttattttatcagcattttcaaattgtcatctaaaatcttcattgacgatagcctgtgaaacatgaatgctacactaaattaaactttataaatttgatttgacttgcaatagatttaatgacttctaaacaatcaattagataagttttataaaaaaaaatccggattaaataagtttttatccattttcaatccactcaaattaatgaatattttttctattttttttaatttctttcaatttaatatagtattttgactgttattgttatattaactcttacaaagcttaattaatataatcaatacaaatatcgaacggtcaatataatctcatcatcataaattattgtgattttatttactcagtcacaacaatttaattaaataaatcctaaaagacatgtctagcatgttaattaactaatattatgataaaaaacacactaaatatttttaggataaaggatcaaactataaaaaaataaaggactaaatatgttatttttaaaaaaaattgtaacccaaaaatcacactatggtgagggaattcaacccttcgtttcgaattcaatactgaagtggcgctgccttctgttctgttgctatggggtttagggtttactccgttacggtcgtcactgactcttcttccatctcgtgaagcgaatctgttactcgttcactgcattgcgaataacatgacattgtcaacgaatcgagatcagactcccaaatctgactccccaaatccctgctgtgaactcgtaaaaaacctctctctctttcactcacttccattttctttttccacttcactttttgattttaatcattaatgtgttctctttctcttatttctcatacgcagtggaagaagaaatacttgaagacccaagaatcgcggaatgctctgcgacaagccgtcaaggttcttgaacaaaaaattaacgaaatccagtcgcggtacaacaaaggtaactaactctttatttatttatttattaaagttttggggtattatataatgaatatttggttttgttcttagtttgcgtatgcaattggtttagttgagtgcataatgaatatgctagtaatgtgattgatttgatgttattctctgcagtatgtggggtcaaagtggaaagagaggaaaaattgggagaatttgttgctgctagggcacctttagagagtgaaacttgcagcttggagtctcagattggtactcccataacagagctgggacgtggcggtggtggaaatgagaatgggaccttacaagctgattgggaaaaggaaattggtagattgaaggagcttatagaagtggagaagggaagggctgattctgagaggaagaaggctgctgaagcttgcaagttactagagaatgagaagaataaggttgttgaaaaggaaaaggaagtcggtggattgaagaggcttatagaagtcgagaagggaagggctgattctgagaggaagaaggctgctgaagcttgcaagttactagagaaagagaagaataaggttgttgaaaaggaaaaggaaattggtggattgaagaggcttatagaggcagagaagagaagggctgattctgagagcaagaaagctgctgaagcttccaagatggtaggggatgagaagaataaggctgcggaaaaggagaaggaaatgagtagattgaaggagcttatagaggtggagaagagaaaggatgattctgaggggaaggaagacactgatgtttgcaagttacttggagaagagaagaaaaaggttgctgaaaaggaaaaggaaattggtagattgaaggggcttatagaggagaggaaaagaagggttgattctgagaggaagaaagctgctgaagcttgcaagtcactagaagaagagaagaaaaaggctgctgtaaagggggagattgccagaattgaagcggagaaggcagtgaagtatagttttcaaattggtcaattggagaaacaggtaaacgaagcaaaaacaaaattggcgtatgagatttctacgtatagagaggcaaccaaaaagtttgaagctgaaaagcgtaaactattagcagagaaaataaatgctgagtcagggatggcaaaagcaaatgaaaggttagaggttgaaaaacaaaaggtcgatgaggaaaaaaggcgtgcagatgcagagatggttaaattaaaggagcagaaggcacttgctgaggataactggaacaagttcatgaaagaaaaatgtcttgctgatcagatgtctcagcagttagaagaggataagcagacgattgaggatttgaaacggaagatccatgaactctcgtccttgacaaaacctgttgaaatggctgctgacagcaaggtcaatgctgaaagtacagaagtgaagcttttaaaaaacaaacttaagcttgaaaagctaagagcaaaacataccaggcaaaaatataagttagaagcaagtcgttacggtattttacgtcacgatttaggtcgtctaaagatggatttcattcaatttctacaacgccttgatatactggatgcatccttttcacctgtcgttggaagtatgcatggccaaacaaaggttggtttcactgacaaattgtttgtagtcatataatgttggagtatttttgtcatttttgatcacctctccctgttgaaatcatgcacacttttgaagccaatgatctcattctggcttactctcatatgcagattaaaagtgagactacttatggacaagtggttatgaacttgttggttggttttcccctaaattattgcaatctttgggtttatcatcatattagctgtagcactaacagtttatttaaccttgggaaatgggaattttcaggatcccctgaaagcaatacataaattatttgggtggttttattatatatcagcactaaataattgtttaatagttatagatagtacttggttttagttttatctttttggggggtgggggagaggaaggaattaaagatttttttgtttgtgagaggcctggttttaggtcagagttcatataattaaatatatttttcaattttattttttctctttttattgtatgttattcttgtgtatgcacaacttaactatttttttttttatctttattgaatgattggtttgcagtttgagaatacactagatatgcagaattcaaatgtcatgagacaaatttgcaatctaaatttatctgagacacgtcgccagtttgagaatgagcttctggaaccctgctgcacaacaattgaggcaagtgatccattgagggaaaacatgaagaacactcaactcctcactccaggtagaaattactctgaaaaatctatcacaggtattggttctaaattggagcctcctgttagaggatctgacagaacaaagttacagagttctgcagtaaattccagtacagaatctttttctgatggacagttgatgggctcacaggatgcaaccattttcccagttactgcatcagcaaaattgactcaggacttcaagccatctgacaaatctgttgatgtgcaccacaggaagaggaaaagaacgcaggacacagttgaatataatgcaaatttatcttctgagaaactctctgatttgcatggtttgatgcatagaaaagttgtcaaatgcttagacggagaaaaagaggtgcttcataatctgaataatttacaggaagagaataaaagggcccacaaaaagagaaagaaatatcgtagggaaaaagtggacatgatacctttggttaacagggatgagcaaaagggcacagaagaggccgacactgaggtctatgatgatgcaaatgtctgtagacacacttcctgccctgctccacatactttagaaacctctcaagcatatgggaataggatatgtgatgctgtgaataatttcaattcgatagttaattttgatactgtgcctgatggaaattatatgaaattattagaattagaagatgctactagtgaggaatgctatagaaaagcaatggattttcccatttctccatctcttcctgaaattgaatttcgtgaaacatttgaagagggtaatttgacgaatacctctctagaggaagcactccaagatgacatgttgagctcaagaacagacctgtttacttcaccttaccttgatgtaattaatgttgaaatcaattctaacgaacaaaagtgtgatggttatggagtttcttgtaatttacatatgcactctacagaaaagtcaaggactgcttttttggtggaggatggaattggatctttaaacaatcaaattcctgaattttgtgttgtcttttcaaatattgaggacaatagtatcatatctacgatacttgttgctacaaaaaattgtatagctcggtgcaatttggctactcaaacaggctggggggttagtaacattctgactgtacttaaaatggaagaaaagctctcacagaagtaagtgtctcacattttgtgatagtatagggtcaatgctgttgaacaccctttatagtttttgtttcaatattttgcttttcttgtaataacaaacaaatcagttcatgataatatttaactgtggacaaatggtggtgttgatattaattttattattttgtttcatctaatttctttcagggagaaggtttcggtgctgttaacacttatgctgttcaactttgccatgactgcatcaaagacatttggaaaactttgggatgggaatttattccactgcttgcaatcttattctgaacatatttgcacaggtttggtaatttgtttcataatcaacttccattttcggaacattaaaagaatgtttttaattatataataatattaatatcatgttatttaaatttgattttaatttgacaaaatttcacatctttttccccagttatgtctgttgcagagacaagaatcctgtttgtagagaattattctttgcgcgagctacttagcctcattgaagattttcttattgagggaaaagtaatagtaaacagtagagtagatgctgaaactttgtcttgtgatttgagagccaatgattttctggattgtgttaatgaagtatcatccgatgtagcttcaagtgaacaattggcagcagcaagtattatattagcatcagtatgtgctgcaactgatcatgttggatttatttgtgatgcttcatatcatattcttcggtcatgcaagtgggattctctgatggtgctgactattctccatatttttgcttatctgggtggagagaagttttttaacatggataattttggattaatggtgactgttttgaaatctctaattatgtttcttgaggatgagagcccatctgttgcatctgcttgtcttccttcaataaatcagctgcatgctgagttgtgtatgaatgttaaatgcccattctcggaaggtgctgaatccattgatgcagttgcatgtttgctcttggaagagataaagcgaataaatttgtcagattccagattaatgtcagacaattataatgctggacaatggtataatcaggatgcagttcaatgtgccattagcaagaactgtgatgtgccctgtttgaaaaaaggctcgatttctgctactcaaccagatgcccttatgaatgtcaacttttgtcgcctgaatgacgtcctgtcattggtggaactggttgcaaacaaaacggtattattctcattatttcaagttaatattgaccctgtcttataatttctttttatcaagttctaaaattaaagactaattctcctaaaataagtgacattatctttttttagaattgatgccatactgaaattaatagaattttacaatatgaaattggccatggtatagttcttgaaagtgatttcactcgtggtattcaccatcatttactaagtgatttgttgccaaggtccaagtttttttatggttgagagttatactgttctcaacttctcatactcgtggaataacttgtcactttattttgttgatgtcatcataatcaaacctgattgcatgtttccttttcctaatacagagctggcactgggctgatatgaaacttgttcctcagcttctgaatatactcgactcatgtgcagaggagaactttgctgttcgtataattgttcttctaggtcaacttgggaggtaaattgatcactgcttcttggatattgctagtatcatgaccacattcatggataatgatatatacatatgtttgtaactttgtatcgatagaggatatatgtatgcttatcaagattacaaatcacttactactaagatgagtattttgagtcatcttaaggaaataatgatttttaattttttattgaattctaaatcccaattgctgtgctagtgtggtagaagccttaggctagggttaaaaaataccaaaatgagtgatttccctggatatcgagagcataggactatccccactctctaagagtcttatcctttttcaaatgataagataatttctctctcaactcccctctttatttattggcaatatgccttatttcttctactgtctcagcctgcccaaataacataactaactccctcactaagggacacctaactactaagggacacctaagataatttatgtcacaacacattctgcttttttggtagcacctacgctcagaatctttgtatggtgatagtttcatttttctcattaacttttactgtacagctgtttctttgtcgatcacatatctgtgaaaaagccatagtgccatggacacatgcagacttttaaatattatttgatttaacaaagaaagatgctttcacatatttttgcttgtgttataacaaagtcataaatgacgttataaatttcaggactggagtagatgttggtggatatgaagataaaggagttggaaacctgagatgttatttgtatacttatttttgccgaacctcttccatgaaagcaggtctttctcttcaagttgccgcggccactgctctgtttggccttcttcctcttgattttgaaaccctttttcatactaaaatccatctttcagcatattctaaatctgtttctgacaatgctgaaactttgagaaagtggttctctgggctgggtaaagatcaacagaaattgctatctgatgtatttagtaagtaattttttttgttactttcacatgaattaaaataggataccggagccagttgatttaattggcaacgctcttggagaagttttgtagattgagcattttttttttttaaaaattagatggcgttgattcaatctttttgagagccttcaacatggcttgtaatcttgtatgctgttgtcgtgcttctgaaatttgtacatactttatttttttggctgtaaacttgtaaatttcttgttattatattttatagtgaaacttgtaatccccttgcaagcgttattgttatattccccttcatggttttagacattcatcgtaggccattactacaggggaccaccttcataggtggggtccattttgaaccatcaatcttgaccattagattaatcttagtattgcaagtcatcccacaccaaatcccccacccagcaaccgctatttgctgtctccaacatcgcccatgatttattttgccacctggtgagatagagagtatgagagagtgagagaacaacttctccattctcaatttaatggtcagatcaatctgattaatggcatccttttgttagcatgttgtatcctttccagatttgaattacttccaatcatccctagacgtcgaccaccatgcatcgcctccagaggaaattttcggtggcgacgtgtgactccctcccctcccccccccttttcttattcgctgacagaggaacccaccgtttcagaaaaccccatctcgctgaaattgtcctttaaaaaaagctgtggaggtcgattgacccaaccagacacaatgagttagatccaatttaatttaacgcatttttttgttggtttgcttcaaagagagatactagatttgtagatcggtcccaactaggcttgataaactttgtttttcttttagaaaattataacaataacaacaacaagcattgtgcggtgcattttggggacacttaaaaaagcttggtccttttaagattgaaggcaccaaggctacattatgaacatgcaaaaactgttcatgggtaaagggggtcagtgagtgagtgtagtggcgagaaaaaaaaatgtagtcgtcagaaatcgtttttggcagtggcgaattgtggttggtgggaggggctgggggatttggtgtgagatggtctgcaatactaaatttaatctaatggtcaggattcataatggacctcctatcaagtggtcaccctaaaattcaccttcatcctaatataatgaagtattcaaaattagaatacaagatcaaatagtcaattcaacaaggacaattggaaggaatactgaaacacatggatgatggcgatggtcattataatagtatgatttgaatccatctccaattttaaacattatttcttaggcagaagtagatttatgttcaagtcttgatttgatattaagcttaattttttgtaatatgcacgacttgataattattttaccttaccaagaacttcctaatatagaatgtagatattctatacaaataattatatatttgactagtgatcaatttactaaacgagtaagttttctatgttttctctatttcttatgaaatgcgaatcatgaatcatgtgataatatcacggtgatcgtgcatgtaacatcttagaaagtgaatactcatatacatgtaatcctatggtgaagatttacttatattttgaaaactgtattgtacattaattcaagttgactgatgaaatattaaatattttttaaattatataaaattttgtatctctttgaactttttcgaaataacttaaatattgtataatgattttttttttatatattatcatgaatgaattattatatatgctcaatttgttaattttttatgataattattttaaaagttatatatagatttttttattggttaatagtataaaattttaactctcacaaaacaccatgcacgaaaattaaattcatgaaaaatataaatatatttgttattttatctgaattaaacgagggaaaatatctcttatttgagaaaaaaaaataaaaatattttttgttactactatgtcataagttaatatcttggaagtttaaagaatattaacttgttaaaataattcaattttttattctgtaatatgtattagccagtcacacaattaatttgtttttggtaataacaatgcttaggggtgttcatcaaccgatccaaaccgatgcaaaccgcagtgattgaaccgaaaaaccaataaccgaaataaccgaaaatcgaaaaatcgaaaatccgaaaaaaaatcgaaaattttcattagattggattggtttttggatcggctggtgaaaaccgatccaatccaaatcgatccaattataaaccttaccttaccctttacctacttgggcctatttcccatcatagtccaaaaatcaaaaactcaatacattgctccttattttgtccaataaacatgtttgtccaatgaaaattagaaaatgatgtttatttttgttcaatgaatgtgtgtgtttatgctagatactccttattttgataaaaataagtctcataagttttatttttaaactttttaaaaaatcgaaaaccgatccaatccaaaccgaaaaaaattggattggattggaccggatttgaaaaaaatttcaaaccaaatagatgatcaaatgaccaaaccgaagggattggatcggatgattttttgcttcaaaaccgatccaatccagaccgcaaacacccctaacaatgcttacacatgcacaagcaatgactcagctcaggtaacattcatacattctattaacatgttggagtcacaagcattattataatacacccaatttttcctattaaatgaaaaagacaagaccctatatgccactccaattaaacacaacccacatggagaaaatgatgatggttgattgtcgacgaaaggtgacaattcgtgaaaacaatgatgatatgcttgctaaaagagaaataccaataaaatgtttacacattatttattattaactgaacattctgtaaattgtaaagagtttaataaatatatttatatactatcaatcaataaaaaatatcctgtgtttaatacagatgatgatattaaaacttaacaaatttattatagataatgattttttattagacaataatgtaaaaaacttttatattttactaaaaaaaagttttttttttttttttaaatgtatgatgctgttattcacttttctcatttcttaacagtcggttgaagacttttagtttagctgcttcacactaccgaaggtcattccttccccactttgaacagtaaacatttttactattttttgcggttcgcatatttttcaagttgacagcctactaatcattcaaaggtgtaaaaaattgaatttttattttcagcaacaccttttttttttgtacaaaatatatagataccatatgtgatatgtctataataaattaataactgaaggctgataaaaaagaaggttaataactgaaggtagttttatctacttgtctctatgtcaagaagcacgtgaaaacaactgaaaggtaccaacaaaacatgttggaaggttagctacataatcttcggtggagcaaatattccacttgtccacatgcatgcatatataattggttatttggaatgcctcattccatgcactgaaactagttgtgacacttgtattgcagtgcacataataaccatgggctctttggagcaccaacctttgctacccaggcttgactcacactcacacattcaaaacttgtcatcagatgccattgaagaattcttggaacataggcctattgcattgagatggtggtcaaagcttgttgtgtgggagtcaaggcttctctggctcctctctggggcttctattgttgtgtccattttcaattatatgctaagttttgtgaccttgatgttcactggacatttggggtctctagagcttgctggagcatccgtagccagtgttggtattcagggtctagcttatggtattatggtatgcctctttatctgctgcgccacttaacacactcttttgaatacattttctattagataaaacttaaaatgcagttccataagtgctttaagtgttgttctttttcttttagataaaatttaatgcagttcgataagtattgttgttctctaatcagattaaagtttcacttaagtaatctgcattggtgatctagatcaatattttttctttctacacagttaaatttgattggaaattataaaatttggcaagtcgcacttactatttaactgactcttcttatttaacgagtttcacttataactgtagttttgaataaatttcaatcaaataacatataatatattaaaagaagtgtctcattttcaatcatttgcatatttgtgatgattgcattttgcttaaatagctggggatggcaagtgcggtgcaaactgtgtgtggacaagcatatggggcaaaaaagcatggagcaatgagcatcatattgcaaagagcaatcatcttacacattggagcagcagtgattctctcatttctctattggttctctggggatttcctaaaggccataggacagtcagatagcatagccgagcaaggccaagtgtttgcacgaggaattattcttcaactctatgcatttgcaataagctgtccaatgcagaggttcctccaagcacagaacattgtgaatcctcttgcatatatgtcagttggggtgttccttgttcacattcttctcagttggctagttatatatgttttgggatatggccttttaggggcagcccttactctcagcttttcttggtggcttcttgtcttgtttaatggtctctacatcaaatttagtccaagatgcaaggaaacctggacaggcttcagtattaaggctttcaaaggaatttggccttatttcaagctcacagtagcttctgctgtgatgttatggtatgactatatgtcgatgtcctcataattttctctacatgcatgcctagataaatgagtttaatttctttgtgccgtcaaacacagttaaaccaatcagaaatcacttaagatataacttttaagtactgattattatatgtcaacaaactaattgcacatgacaatttgtaattggatgataatgtaaaaacgtcttacacagtaagtgcattactatttagtacatatttatttggattttaattgagtgagctcaaaagtacttttgatcccaaatcattaaaaccttcattcttcattttgtgcattggaaatcacaaatgtgcatctcaaaattacttttccaacttttatccaaacataccctacataagtatacacatcacacaccacattattatttacatcaatttgttctactaatctaaaaatgtatcttaatgtagtttggaggtatggtacaatcagggactggtgcttttatcagggctgctctctaatcccacaatctcactggactccatttccatttggtatgttaatattttttcttggaataatttttcttgttatgtgccaacgtgttgcctaaccataatatctttatcctaatgtgctttcagtatgaattacttgaactgggacatgcaatttatgttaggccttagtacagcagccaggtttgcaacaaaacgatgtgtttttcattcaagcaactttctcaaaagcatgctaatggtagtttccatgattgcagtgtccgagtcagcaacgaattaggagcatcacatccaagagtagcaaaattttctgtcttcgtagtgaatggaaccagcatcctcattagtgtggttttctgcacaattatcttgatattccgggtttctttgagcaaacttttcacttctgactctgacgtcattgatgctgtgtctaatttgactcccttgcttgctatttctgttttcttaaatggcattcaacctatattatcaggtaataaagctataaaaagtacactagcataagcaccaactttggtttatcacacttttgttaatttttcttggaaaatttcaggggtggcaattggaagtggatggcaagcagtagtggcttatgtaaacttggcttcttactatgttgttggtcttactgttggatgtgttcttggcttcaaaacttctctaggagttgctgtaagtttggaacatctctgtcactaatttttaagtttgtaactgattagtttcatgcaatgcattttgtggtattgttttagggaatttggtggggaatgatccttggagttcttatacaaacagtaactctaataattctgactgccagaacaaattggcaagcagaggtaatcaaaactctacatcagaagatcttatacatgttatattacatcaattttttgtcacatgtgaggtggtgaaccaattcttaatgcctttgaaggttgaaaaagctgttgttcgcatcaataaatccgctgaaaatgacaccttagatcaactggttgctgacacttagaggcattcgtcttttttcttcaggcttggctgaaatgcattttagctgcataggaatcttgttttggactaaaggaatgttgttgatgggtttcttcaccctatttaattttatgttttgttcacaattttgagaatctaataatgaaacctaactttcactgccagcataagtaattgacatattattgcgtggttggatatgtgtttatacagtttattctaactaaacatgactttgcagtaatatgatttttgttttgataacagatattagaaaattaattcgacacacaatgttatttgaaaatttgtaatcaaaattgatttggaacgtaattaccaaaatttcttgagtctaactaaggatatgcatgtaacaaataacatgacaagggtatacatgaacaaataacacaactcaatagttttgacaaaaaggcctcatttcataacttcaaagagacttgagtctaaaacttataattcatgtttctaatataataccaaacatcatgatcaatgaaaaaattatttgactcattttaacctcaaacttagacatgttaaatgtggatccaaatacacattagtcgtaattatttacaaaattatgagttttctttctaatataatgagtatcaaccataattttgtatttttttttaataaattttaattaataattaaaagtatattaaaagaatgtgttataaacactaatctaattttaaaaaaataaaagtaagaaataaaaagtaatatttttatgaaaaattaatttgctcttaacactattttactatgatttttaataaaaaaatcatttttatttattaagttatttatttatttagtataggtcgcatcaagagagcagcagaaaatgagacgttggatagatcaactggctatcaacaaataagaggaattaagaaataatagtaatacactgtaacatttttttaacacactcttgtactcttttaaacaaactatccattatcattaactgaaattggttcaaatttataaaagtttgcatgtcaaactttatttaataagtcttacgattttataaatttcaataaattttaactaataaaatatatatattaaaaatgtgttaaaaatgtattagaaaatgttattacttactaatattccttttatcttatatttttcagacatggtttaaaaagcattctagctgcggattaatcttgtattgggcctaatgcagaatgaaatgtaaatgcatggttgagaaaataatgtacaaataattcctttctgcttatgccccgtataaaatgagtgaaatgaattgtaatgttagttaaattagcctaccataccaaccaaatccatgcattcaaattgaaatgcccgaaaaaggaattaaaaattggagataagttagatgataaaatggcattattattggctaaatccgatcatgaattaaactaaaatacaaattccttaaacccattttatgttagttttacctatctctaattatctttctttttcaaatatacatcaaattcattaaacagcgacagaatcagtatatcaccaagaattaaacaccaagccaaaccttcaacccagaattgtgcccattgtcaacttgtgggcaaatttagtacctttcctaggaacaaagttcaaaatacattcatcaaacaatggcagtgctaatcttatgccctcataaataacacctagttcagaccaatctgttacatttctattaatatcacctacctttttgcaatcactttcgatgataatggaactccaatcattgtgagcagcaaacttcacaccatcgatgagttccgtatgataaatatactgttctggatgaattgaggcacgaaacatacatccatgtatatatcctactgttctaccggtctacttacaatcattgtgcaaagttcttcaacgataaaataagtcctaaatacggtagagcttaaaaacaacaaagaaaacaccaatgcgttaccatattattagcaactataactaaaagtgagtgcgtgtcattccaaattacgcatttctgcgttattaatgagattattcatactctaggagtcacagcacctcccagctactcaagttcaacacaacatttgacagtggatgccacccggaagggggatgcataaagcctcctgagattacaaacgagagatctggagtggtatcactgaggcatcctctcccattaccggcgggaccaaatctagctccccataacgctccaggacacgcatcctgcagtcctcagcagccatcattccagtagagtatgccccatgcacagatcccgtatacaacatacttgttgcttcccctgcaaagaataaattatctacagggacccgtagcctctcatacaggtcatgtggtttcccaactgcatcatagctataggaacctagtgtattaatatctataccccatcgagacacaagatactgaatctgcatgattgaaacaaattacatcttcaaaacaccaacaacatactagtcactgaaaaacaacttattcaattcaaccgtatagcaattgtcaaagaatatatgtaccggaactaaactgagtaaaacttaggggtctgcaatatataaatatggattgaagcatttacttttcttgcatagtaaaaaagtgaaataaatcatcaaaattatcatggttaccggtgaagaagcgtctggaaggatctttttgagctgcgtgaaagcaaagttagcagctgcttcattagacattttctcaatgtctttggccagctgcccagcaggcatgtaaacaaggacaggacgacccgtagccttgtggagattaagaaagtagctgcatccataagatgtctctgcaactactcctaggaattccacattaggccagaaaacatttttaaagtgtaaaattattttattctcaatcccaaccccaatatcagaaatggcagcttctttccagtctggtagctttggctcaaattttatccaagatgccttcagcaccccaagaggtacagcaacaatagcagcgtctgcaacaaatgttttcccattttccactgtcacctttacttcattatattgcctaactatttttgttaccctgagaagaggtattatgaatgccattaaatttagttaagcaacacaacgggggaagcagatttccaaaaccaaactttaaactaatatatacctgtgtcccaggcgaatatcaagacccttggctagggtatttataacaggctggtaacccctgaccataagaccgtgaccaccggggagtaatacttcctgtatgcagataaacagagacgaataagtaatacacgaaaaatgttgatggatgcatgtagtaattaacaataaagtagcaacataatgtgactatgatcaccatatgaagccacttctctatctcatattgcatcctttgcatctaatatggcggcacacattaccatttaatctcaaactcaaacctatagggcataactatgagtttgcaactttacgagcaacattgtattcaattataagtatatacaagaacaaaaacaacaacgataaatagctgaaaaagaaaaagtttcccattcacatcagcccactagtactacctattaatgatttgtcatgcaattcaaatttcaatgacataaacttgaaatggatatatagataatagaacccaaacatctcaaacttggttttgtcaaattacctgatcccaacatttcagtgatatggtatcagcatctgtagcaaaccagccctccattctgcataaataccactgtagcaccttgtgggaaagcccttctaacctgcatccaacagagaaaattaaattatacattacttcagctctaagaaaatcaataatggtggtcaaaggattattttatgccaataatcacctcaattctggttttctttcaaaaacaattgaaagtgcacggagtatggacatatcttcactgaattcctctcgtacattatttgtctgcattaaagcagggtcaatctttagaggtgatgttcataataagtggagttggacattaatagaatcaatcagaaaaaacaatgtattaataagcgaataatcaatcagataaaccaaataactagaaatattaaattactcgcctcttctaaaatcactccaaatattttaccaatttttgctactaactcttggggaacttgattcccatccatatcaaaaagtgcatagctgcaagaagttgatgaatttctataagaaaaaacttgtatctgataatatataccattcagtataagcaaaggataaattgaagcatacactaccgtcaccaattaattatggaagtacagcagaaatagatatctaatatcatttattataaaaaaaagagatacttttacctttccaaatcatggtcataaaggacagaattatcctcactagtacggtaaagaggtagtcccagcttcccaatcaatggagccagtggattctccttgcaaactccatgcaacctgaatcacagtcatccatttttaatactaaaacatggagaaatgcaacattcttgtcaacatgaagaaaaaaaagagaacaaagagagtaagctttaccacgatgcacccaggtcaacaggaaagccaaatgagtagtcagtgtgaattcggccaccaagtctttcccgtgattctagaagaataaccttacaaataaaaagtacaatttatgcaaataaataaattaacaagtacaaaagtatgtatgttcaagagggggaaacaaaaaactttaatacctgaaatgaggcatcttgaagtgcacgagcagcagcaatcccagccatgccacctccaatgacaataacagatggggacctctcctgctgcttgtcatcatttgcacagcaaaggcctacaaggaaggaggagggagggaatccaagtcaactttagcagatacacaaaaatagaatcaaaacttctgaaaaaagacaattctcagatacacgagctggcacaagaacatttcacttctaactttctgtttttataatttggaggatgacccaagagaatatttccctctacaaatcatacactcatcattctgttctgaacctacttttgagtgctgcacgtacttttagagaataatcctctttgtatctttcattctgaacacatttgaaacaacggtaatccaaacatacccaaagtcgtcatcatcacacctagattcgaagagattgcaatctaattcttccaatcactttcagaagctcgattgttagaccccaccagccaaaccatctatttcaaagttcaaattacgcaaaaacgcatgcacgtgttcacattactctttcattcgtactacataacgaatttgatcaaaatgcatcattattatatagaaaaacaaaactccatgcactggtatctataaaacgaaatcaatttaaactgaaactgtagacacattgaacaaaaaaggcacacaaaaaaaaaaacagcgcggtggagaacaattaacaaacctctgcgtaattgcggattactcttgaatcgggactccatattgtgacgaaaaccggaaattacgattgagattggttttagcgttgatcaataacaagggttggagggaaaggagcgattggggtgaaaaatggagggtaaaaattaagaaagaagtaatgaagtgaaaggaattgaaattggagaataaacggagtttcccaaaccagctcatgcagctaatttttgcagagcccaaccactctcagctggatcggaacgcgaaggtaggggagagaggttggtcggtgtttggtttccgagaaaattcagagaaggaaaaagaaaaggaaaagaaaattcattcattcatataattggagtgtgattgggaaagaaagtgcattgcaggttaggtttggtttttaatttatgggattgctgcttgcgttgtgccacccaaaccgacgaggatgccgaagccacgcgtcttacatctctttctttaaaacctaggcatgtaaatgagccaggccccctgttaggcttttggtcaagagtatttaatgtctcatttgatttatttattataaatatgaggttaaaatttttaaaaaaatttatttaaataaaaaaagttatgttcaaacttaaaaaagtatgttaaatttattatattgatctatttaatatatatattaaaatttaaaaataatatatttatttttttaaaaaatattttttttattataaagatggagaatgatcaattacttcaaaaatcattttaaaaatttcataaaataattattaattatttgaaaatataaataaaaaatattttctgtttaaaatttgtttttttaatttttttaaattgatttaaaatattttgtaaaattaatttttttattaaaataaattttttaatagatttgtacatcaaattaaatttttaaataattcaaatcaaacttaaaaaaattataataaataaatagatgatatcaaattttatattttaatttaggtatttttcaccccctttacgcgactttgtaactcaatcataaggcttcaaaaagatctttcatgattgtacaattttggcattttaaaatattttattcaacatctgggtgttcacgtcttcaatttttttatattaaacttaaattattgacgtgacattcacatggtattatgtgataaatgtcatagtttcacatattagttatgtgtccaactaactaaccatgttgatacgttagtgttaatatattatgttaataatttttattgaaaaattaacgacaaaataatgatatacttaaattcttaaattttgaaaacactaaaattaatgctatgttttttttttatcattcaaattgcaataacattaattttaatgtagttcaccgcataagtaataaaggagttgtttttcaaaacgtctatggaagacaacaagaaaaaaaatacactaatgatatgtttggttgtgaaaaataaaataaaaaggaaagaaatttataaaattttgtgtaaatctcacatatttttttctatttaaatttttaattctctgtcattcttttttcttctttccaacgaaatcaaccataaatatggaaattaaaagtggatttaagtcatttagttaaaagtctttcaataaaattttcacttttggatggggtcaaaatttggagatacctcgaatctcatcagagagacaacattcctaataatgatagttaaaaaaatgtttcaaaaaatttttcaccttttaaaaaagtaatttagtaaaaaatcagaaaaattattttaagaaataacatatgaaaaaatcaaaacatttaattgaattattttaaatccaacttatatataagaatcaatctttatgagaatacttgcttgtgtgaaaaaactttaataattttcataagggtatttttgttttaaaaaaagaatttaaagttgaaggtaaacttggaaatcaggggtgcaagaataccaagtcccattagatgattatgtatcatagttagaagtgagcccaaaagacttggtcaatgatcaccaactatttatttctttgacaaatgctgaccaagtatctttgagtattgattaaaaaattaaaaagagaaaaaatttattgaaacacataaaattatattatttataacttttttatgttctcttgtgatttatacaataaatatttattcttttttagtttcttaacaaatatacacagattagaaagaccctttttttaatactccttttagactcaaatataagaagaaaaaattcatattaactaagaaagttagttactcataattatttgtaccaatttcaattaaaaaaaatattttctaatttattcttcattgaaatttggtaccagaaattttttttaaaaaaaagtcataaaagactaatacatcaattaaatgaagagtattttaaaaatgataacaataaattaggaaaaatatagttggaattttcttatatttaagaaaaaaagaatattttattcattatatttaaaaccggaagaattattattttttattcaacggtgcatccccgaacacttactattcaatatacaaggcttgaagtaaaacgattaggcccaattgcagatagtggctctgcagttttgagcttcttaattatattttgggaggataaaccgaaaaaagtaaacccattgggtttctctgttgaataatttagcaaacccctgatatatagaaggaaactaccatggtttatggatttgttggatacacacaatcttcaccttctagatccaatgtttacactcacgcatgatttaacttaactaaagaaaattatgcaattagaaaacaaacacagtaaaaactaattcatactaaattaaaaacttagttatttatattcaattgagtaaaatgtatgagtattgcaaatttttgatatcgtctttaatttctataaataaaataaataaatgatataattgtaaacaactaattgttggtgaaaaaatgccaccatattactacatccataagtaattattaatccattgcatttcataaattttgtaatctttgtttccttatattcaatgtatattttactataagcaacatgattcaggagatataaatccttaatttcttcaatgatactactataatttattactttcctcatgctgaaaatgaaaaggtaataaatgatgtgattgttgcattaggtgagttatacttgtatgacaatatttggaaagtatatatttgcatgtcctaaaacgttcatgatgaagataaaagatgtgaaagcaaaatgtatgttaattagttgacaccttgaaaaagtgcgataagtgcaaatataatagatgatataatataataataagaaaagataaatagaataaaatatttatctgaattaatcttaatttaagacaattaattatcttcatgctgtgtcgagtcattgggacagattttggcgtttggcacgtaaagactaaaaaagacaacagatgtactgcaaatgaggtggccatgttttacccactctgtggttgtgtcggaaactgccatctgctaactaattattcaacttcaaggctccgacatgtgtgtgtgtatatatatataataataataataataataataataataataataataataataataagaagaagagtataagaagaagaatgaaggttcatcaacaaaatttgtgagcaaggaggtataccccacagttccttgaccaatcggcaaccagccaaccactcaaatccattaaacatcaaaatatatgcagccaaaattaccgacatcacattttttgtttgcagctagctgaataccaatgtctactaatgatatgtttggaacagagaatcgagagagaaatgagaaaaaaatacatttttttcatttcagataaataattttttatttggttatcttttctcaaccttccattattattttcttatattatataattctcctaatttatgaataagagacttggggtgacttttactttgttctttatttttctctcttgattaatttttaacgattaagatatataatttgtaatattttttttttattgtagaagagaataaaataatacttttaaaaaaatggaggaactaaatttaaaggataaaaaataaaagtagcctgaatttaagaaaataaaaacatatttatttatttatttaaaaataatataattaccatttatttacttacacattcatcattatatttaaattaattaaggatataaaaattattaaaagttttttaactacttacattttctttctattatttttctttttaattaagcaacaaaactatttttttcttcatccttttctcttctctttattttatgttctttttctctaatttctgtttcaatctccaaacaaaacattaacattaaggatgattcttctttaatagtgcaaaggaaattacacaatacaagtaggttagttatagtgaggtaaatagttatttttgtttctgaatgtgtagaacgctaataaatttatttctaaaagatgaaaattcaaattttagtcctgaaaagtgaaaaaatgtgacaaattcattcatttattaactttcatctgttatcattaatgaaaaagtctcatacgtggtataaatggatgaaaatgtcacaaaaataactgtcaacatggttgttgaatatatttgatcaaaatgtcaataaattttcaatagaccaaaatatcaataagttttcattggactaatttgtcaaatcccaaaatttgttacatttaagagtaaaatataatttaatcttcatcttcctcccccttttttattcattgaaaacataacattacaataaacacttaaaaaaataggaaaacaaacataagttagaacaaacataataataaacataatacgtctattgctatgaaatttctaatgtgacattattttacccaaaatatgagactcaaacaataatgcacaaccattaagttaatccttaaaaaaaatgagctccaacttgattttgtcattatctaatattgtcacaatagaaatttcaaagcaacagacagattatgcttattaatcaatattatgtttgttctaatttatgttcactttcttattttttttaagtgttttattgtaatgttatgcttgtaatgataaaaaaagagaaaagatgaagattaaattatattttattattaaatgaaacaaaatttggggtccgacaaattagtccaatgaaaatttactgatattttggttcaatctatttagcagtcatattaacaatcattttgtgacattttgtctctttgtgtcacataagttctttaattaacgataatgagcaaaagttaacggataaacgaatttgtcgcatttttttttactttcaaggactaaaatttaaatttttttattttttatcaataaatttgtcagcattttatatattcaacaacaaaaataactatttactcattatttatttttagtaataattatgttttgactttttgacctattaagaagtcatccatcccgattgcttcgacagcgaaactataaataaagagaaagaaagccaataattagagccttctattttttattttttttacatcgctattagtggcagttagttgattaatttagctatgtaatgtgacaatatgaatattccagcgattattcgagataatgactcctaagttcaatttgtgggtataaattaacaccataatgaaactaatcttttcaccaaataattggtaaataaagtttgtgagagttgatacatatcaatctttttccaacatgcaacttcaagaaagagataggtgtgtgggaaaagtgaagagaggtatatagaggaagaagctagtccacatacgacgaagttggatggcacgaattaatcattcacctatctattaatattaatattataattactaggggaatagagtccgtgcctctctaaaaaatttaaataacaaaaaaattggaattaaatataattaataaaaaaatgatagaataaaaatatataaaaataatgggatattaacgtaagttaagagaaaaaattataatttaagaattagtttaaaggtaaaattgtacaataaaaatgaataataattagtaaatgattccctaattttgattagtggataaattttaatcagcataactaaagaagattaattattgtcactatattaatatctatactaatagatagaagagatattcactgtgtaactgcttttggtctccacattttttacactattttaccccttaactaaaaacaaaaatcaaataatcacccattaaccactcacatttttccactttgacaccattttattattcatttatatattaacattaatattaattaggctctctcacccttcatttcaattattattagattctgcctccattcttttttttttttttctctctacgccttcttcttcacttcctccttagtgtttgttacttcaatttagtgatttgttctttctggattcaattgaggaaaaaaccgcatggtttgagcaatggatgttaaagttgcacaaggttacaactttcagtggtggttcaactcgaaaggattggaagaagaccacctaacatatgttgtttgggtgtgtcttgggaaccacaaagcttttgggtttttattttgttaacgatgatgcgtcgcaaaagaaccgctttggaggtttcatgttcttacgacaacatttcagatttccattctaaccaataatcccatcatgtttatatatatatatatatatatatatatatatatatatatatatatattaatttttccactgctggtgttgttgaagtgtcattttgcttctatttttatttatttattatttaattttggcgaaagaattgttagttctgagctatatgtctttcaaacaaaatgaaggattggtaattgcatgcgctaagaaggtataatgaagtaatgaatcatactttgtgtaattttgtgtttttcttttctcactccacaataatttttctgtaacctttttttatctactttttttctttctcttctccttctttaactttatctttcatgtatagttcttttaagtataaatttggtttacataatgtttacatattcattttgataacatttggaaggatggaattaaacatgacacacaacacacaacacgcaaaaaaatatggttataattcatgcaacattacattattgtcttgcatgcaaagcattcaaagtcttcttcttgatctttttttttttatttagaaaataaaccgaaattgattaattgtttgaatttatgtaagttattaaaacatgaatgctctattacaataaaacatgaattttaatatctttaaactaatgtgttcttataatgatttcaacatctagctaaaaacaaacaccattctatatttctataatttattaattttgggtataaatgtttaaaaaatgataacaaactaaaaaatactttcaaaggaaacatgatttgaatgattttgttttattttacaattataattagaaaatatttagataatctttattttctatacattttttttatatttactttatatatttatccatttatcttatttttctcttcatcatatatcttactttgaaatatataaaaaaaaaagtccttaaagttgaagtatatgcacccaaagagaaaagataattaaaaatcaaaataagagatattatctatacattaaaaaacatattaaactaaaattaatatacacatcaatttatatataataagagatattattttaatatataaattttagtacaataaatatgatagtataatataaatgcagatacacaaatgcaatagcacatgtgttttactagttattaaggataaggataaaataatatataaaacatgtaaagaacaaaaaaattacataaaattttatatcccttttatagattagtataaattacatttccccttatgtgggtctcatctatgccttctatcattgtcgtttttattgtatgtgtttcacataatttgattaatttgcttgcttaaaaaaaatataatgattcatgatcttatcctaaagttgacacagtttgaacaaaaattttgagggtctacgcctttcgtggggaaagatgatggggacagatgtgataatgaaatcaagtgattaggattgaaatggagaatataataaaaacatatggcagtgggatacgatggcatattgtgcacttcaagtacaataagcagggagacttgttaaaaaagattgtagaacgaatttccggttttaaaataaacttaaaccgttgtttactttaaccatggataattggatatggattaaggtttaaactaaatgtcatatcacgaactcaaagattccaaccaggcaaagtgacttgggatatttttgtctacgaatgaaaaataatgagtgaaaaaaagaagaacgaaaagatgatattaagatgactatcgagttttttttttttcattaatcaattttaaatatcaaaaataataatgaaaaatgttttagttatttgcggttttagtacgagtatctgatgctgactaaataaataattgtccgtattaaatttatgatatattcaatttaagtaattttaagttattggtaccattacttaattatctgattaaattaaattgtataaagtttgcatcatgcgtgttatgtcctcacttttattatttatctatttgcataaacttattattgttaataaaaatctatagttttttttcctgaacaaatatgttatactgtttcttctttttcaagtatcttttgggttatttatatgcatttgtccgaaactatttcttagatccatatataaccagtgtcataccggtataattttagatattttcatattcagttgtgatccattttaactttttgtgtattactgtataatttttcttataagaggaaaaaaaatattaacgacactattgatattattaataaagggtcattgcactaggtaaggtggattgcatagagtacttaatgttatttagcaccaataaaaataaaagctttagtaatatatatatatatatatatatatatatatatatatatttaaacctttcaaaatttcaaacagtattctaattaataaaaatttatttcaatagtaattacaaacattctaatatatttaatgttggttgaaaaatttaagtattttgaatgaaattatgtaaagtaaaaatctcccgtttaaataactaattaagaaataaattatttttatttgatataaaaaactcataacacacgtcacagtataaaaaaaatgtgacttcataagaaaaaaaagaggagtattatcacaatttcatgagaattaaaaataaggtgtagaatttgtcattagttgataaaaaaaaaaaaggtgtcgagtttaatatggatatggagcagctaaggtaaaagacaacgaacgtaagaatttcaagctttaattccctaatctatattattgatagtaaaacaatagctgttatcgtaagttcagatatagaagtacaaattaaaacgttaacttatataatttacttttcctaatctacaaagtacaaacaatacatcaaatggctgaacccacaatcaaggacttgcctgatgtatataatttcgaagttaaacaacaaactttaaattggatataaatagcatgaactccaaactacataaaattggacatattggtgcttgtgggatttgacgtactccattagctaattcccccaattgagtaattttaaggtattgctatccattattcagttaaaagtggaagaacctggaaagtgaaaaggaagtaatggagaaggaagataactcagtgacatgacagatttaattatgtgaagtcagtgagtataaaatgacatgtaacatgaaatatttaaatatatattacgttattagtaaatagtgaaacagattattgttaaaaaatttaaaatctttgaagattaaaacttacattaaaaataactataaggacataaggacacgtttgataggagagacgttttgattttttttgaaaattttgggttggaaatcttaattttttttatgtttggtatttcttttaaaaaaaagattttgggaaaataatatttttgaaaaataatttttaagaagttttccatgaaaacttttttatagggaggtgaaaatcttacctttttttaagcttaattttttttattacaatatatcatgttatttttattaatgtgataaataaatataataattcttcaatttttagaaaatttatctaaatatttttaatcatcaatcaaacaaattttacttattcctatnnnnnnnnnnaaaagcaagagaaagaaaggggagagagaacatgaaaatagaataaaaataaacttttgttttgttaaaagtgatttcacttaattttctttattattttttattttaaaatgtaattaaacaagcaaatttctttttaaaaaggaataaaaatccaaaaaagttggaagtatctagtgcccttacctgctttgccactaacaagatcatcaatattagctgttcccctcatgggtccgctgctattattgcctggtgcaatcattgtttgactatgttgcactgcttgggaaccgtatctgaacacattcataggctgcaagataaaaccaaaaaaaataaaattaactaacaatggtgattaaaatataaaaaacgttcatataaagtttaaaagtttattggtcatgtgtaatgacagtataacatctcatcacaaatgtacttttaaaactatcaaatttataattagataataatataaaattattttactttattattattatccagatataacttttcttctaaaaaaataaaacaaaagaactaaaaaaataattggtgcacatgtaaatatcaaatgattaagtaaagcaaagaagaatgaaaaaatttcacttgaaagaacccaattaaattacctgagaggcacttcgcatgagatggtaacccatgtaacgtgcatattgttctggaaggcaagggttttgcatatggttttggtaattaacggcacccaaaacttgattttggcacattaaattctggtttggcatctgaggcacagacatggcttgaccatgtggtacatttggcaattgcatcgggttgggtgcacccattcccatacccatttgtgacatatagtgctgaattcctgggaacatcactggtgtcatgccaggccccatccacattacctatcaccaacaacaaaaaattgtcacatattactatagtgttagaatatatcatcacatgcatgcatgtgtatgtgtaagttgtacctgaagctgaaactgaagcgatttcaagtattcgattgcctcttctaacattgatgctttgtcagtctgcgcgtacaacccattgttattttacaccacccatgattgaatcttatgaaaaagtagaatcattctaaaaaaaaaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctaaaaaaaaaaaaaaaaaaaaaagatgtagagtaataccacttttaaccttaccaatcatccgagtctacccaaagtaatattacatggtagaataataatacataaacacctatacagtatatctaatttaattatgctctttattttttgttttttctctctcatcaatagtattatttattatatttatacttttttctcttctatttctatccatctctagctgtctgttagcgtataaatgttcacgcatcgttttcggtctagatgcatgcatctctacagaaaaaagttaacgtagtgacaagtcaacaagcattatttgataacgaaccttgttactgttaggtatcagttgctgcaatgtcctcatcttctcgttgatcctatctcttcttctctgcattagtaaaataaccccggtagtaagagttaattaagttgacacaacacaaatcacaaaattacaataaaaaaaccatgcgctcaccctttctgattgattatgcacttcagctgcacggttccttctggaagaccccgtccgctgagaagccttgtttccatcagctgatttaagttctgtggcctattacaaatgtagacacatctcatcagcctacaataatgccaacaacgaatctttttttgagttatcatgtcttctatgatagttttacttatgattagtcattatcagaaaacttgcattggctgatcatctttaccggacttcacttctaactactcattttctatttacaagactctaatatgagaccttactatgaaatccaaatctaattcttctcggactaatgtaatgttggtgcaacaagaaaatcttgttcttctaaatgagaatagttacatggatcacacatgtcattcaattcaatttttgactaaatcttccgaggccatcaggcaaaaagaaaaaagcaagcatgcattcatgaatgtaaatggaaagaggaagagcatgacctcactttgttcctcagatgcttcttcttctgtcccttttctcttttggcaatgatctcttgttgatagggaacaaattcttgcaataccagtactgcctgagccaccggaagatgaagtcacagttggttcaatcatctctgatttttctttgtcactactaggacaaattggtctctggacacaatctcttacagcttcaggctcagcagataaagtaatattattagtagtggcccaaacaccactgcttgaaaccctgcttacatcttgctcctgagggatgtgattgctgccactgtgacttgaaccacctgtgatcactgagtactctctagcctcactttgtgacaagttagcagtagtttttcccctaaactgtgtactgccagatgctgaagaaacattattaaggggtgttgaaaagtgaggaaaatttagaacctttggtgatgcaccaaagtcattgattttctgagatgaatcaggaacatgaaatcttggagcaggcataggaataggattcccttggattcgttgaacaaatgaggatttcatgttaggtggtagtggttttgaacttgaagtagtaggatgatggggggtactagaagcaaaaaaattggcaaacttgtcctcttccaattgcttgattggcttgtaagattcaaattcacaagttggtggtagttcagataaaaggtttgaacaaaaatcttgttccagtgggtcctcaagtgggaattggatccatggggtggcctgttcttgatccaagttgcttgagtttccatagggaccactagaccttaatgttgaatgatctgttttctgcacctgtctcaagttagatgaattccctagtggcttcctatgtgtttggttgtgcctcacaacttgcccattttgccataggagctctacaagttcttggtccggcctgtataattgaccacacagagaattataatcaagccaaagttaatagggacattatatatcctgctttgacaaagatagataacacacaccctatgagctttctttggttggtgagacatgcatcactctcaaaatcccaaccaggaatactgttcttcatggttcaccaaatcagttgtctgttagaacaagagaggagagagaactttagacttagagcagactttataagcagagtaaaatagaataatctgcaaagttcagctaattgagtaatcaaataagcatatagaatttttgaagtgaaagaaaaaaataataaagaaagaaagaaagctttcgggtcaagtgtatgcagcttgacttgccaagagggtgaaaaaccaatgaaatggaaccacaagttggattttgccattgtgatcaattgtgtgaataaataaagcaaggaatgtttaaactccaagagacccggaaaggaaaattattttcctattattacattacatttgaaagtacatgcaaatattgattaacaagaacagaaaaagaacaaaacactaaagaaatacaagaactgaaaaaaataccaaacttttaatcccaacaaagtgggaaaaaattgacagagttagttggagagctacactaagtattatctcaagaatatttaaacacatacacttcaaaaacaaagaagaaccccacctgagttaaggtaaaaagagtttttcttttaggctgcttttttgcaacttgttgaatagaagctataaaaatagatgctaactagagactgaagaaacaaaactccctctgaacaagtgctaggttcagcttgaggagtttggtgacagaggttgtggcacagtttttaacaagaagaaggacagtgacatatccaagttagtacaaagagagaagagagcaaatatggcatgaaaaaaatggtactaaatagtattgtgcttgtcaacagcgagaaaaacatggctagctgcacatgtggcttcagttgaaaccggggtctgcaaagattttgctgttcaatatgaaacgcaaacaaggaaaatccaattctccatgcacacggtggatgctatctgagagtgcattgtgatgacacgtggcggggacaaggtgtatattattggagattgataaggctgaggcattgtctgaaaaagaaaggaaaaagatgtggtacaagtttcatgctcatctagacatcaactaatcaaaggcatcaactatctaccaaatatacaacctgtctcatgagtccatttttgtaacatggtcctagaagaatactggccaactcagaaattttcattattagttcaaacgagtggaaaggataatgcagaatctgaattctctcttgatcttaactagtatgacataataagagattttttttttttttaaatatcacaattacttgatgaatctattaattgtagtagtatttgataaaattgtatatatttttttaaacatgaccatatatcatgttacttatttttgtgtgtgtgtatgaacttgaatattttgtggctataagttagagaccaatctccgaatccattcaagagattttctatacacgtgaacatgagaatcgaatacttaatattgtaggtaatacaagatttttatatatgattcattatgtactagaaagtatcctttcatgagtgaaaataggataacattgaaagcaaatagcctttagaaattttggtgagccttgagttaagctcaaatcaaagtgtataactttaactttgtactttggataatatcttgcatgtgaatgatgtaattattcggttttattgggtcgttagcatttctatcaaaaaaatctaaaataatgaaaaaaaatagtccgtctatgacaaaaaacgaaaactagcagacgaaagaaaaaattggtatttcaaagacggtatttagatatggaattatccgtctttgatttgtttgtctctagaactgtctctatattgtctagttattctcagggatggatttcggagatagaattggtccgtgacaataattttcgtctctaaatttgtctttgaatatgcattttgagttttttttttataaaaaaaataactaaaatattagagacaaaatcattaggtctctaagtttctcttatttatttattatcatttttaaccatttaattcattaaactcaaattttcttatgatttgtttgaaatatataatatttaaaggagtaaaaacattatcaatgattaagaatatttttattaattaagagaagtttcttcatctatcgttgttacattgttgacaagtagccttaggaaaggctgaatgttttcttatttttatacacacatttaagaatttttgtattttttatttctttttacatttaattatgtttcatattttaaagtttcaattttctttattcttttatgctaattctaatagaaaaggcacatatatcatcacactgttactttctccatcccattataattatcatcttatgttaatttacacatatcaagaaaaattaataaatgaacgaaagagaataacaattttacaaaattaaagttataccattaattcaattttagttattgtaaccatatcattaatattataataaatataaatgaaaaaagataattaatattatattaaaaagttaaaataacaattattttgaaataatgtttttttcttacacgataattattataagactgaaagagtagtacacaagcaaaaatgttttgaaaactaatgaagaaaattctaattgtattttagttatacctctattcttgatattattaagtaataccaatgatttgtttttagaatttgttgtaattaataatttttctagatactctacttagaaaaactaatgatcacaccaaatcactatcagcataattagtgatccagagaataaaggtaaaattaagatataatcaaaattttcttcattaaaaagtatatataaaaagtatacacaatgttaaatataatgttaactattttatgttgagaattgagataatggagatttagtaaagttgcataacctaaatttggtgagagacagaaagcgggggtgaagccttgaggtccaaatgacaaagatagttcatagcaaagcaaccagccaacttcttcaccgcaccaaatgggataggaattcctctaatcagataccaatttaatgcccacattcaatgttatttgcccttttctggatacatacatgtaaatcacttccttcatccttaccacttcatttttctttctttctgaatcatatgtatctttcaccttgatataattatcttcgagttaaatagaattattataaatgacataattatttatccaggtatttaatgcaataatattttcaggattcaaacttgaaacatctgattaatttgaaataatttcacattaattaatacatgtacttgatgttctttacacttaaattttttagataaatgcttatttatttttcaaaaattaataaaataacgtatatttttaaaaataagtttaattaaatatacattgagttttatcaaagtatcagcccaaggccaagttccaactcgaaagtcgttttaccttcaaggcttcaaatcaaaatcacccaactgtactttagtctttagtgtagcagaataatggtataatataaaaataagatgaatgtaaccttcaagcattcttatcatatgaactctcgtgttactcaccacattcacactaaggtgtgtacgtgcatattaaattattaataaagaccatggtagaaaaaccacgacaaataatgttgtccgattactattaaagtaaaactcaaattcaacggaaggacaagttcatgaaacaaatttaaacacaagtgtaacgtgggaaaggtgaggttagatctactaagaagtaggaattttattcataattgagttaaatatatttttagctttcgtaaaataagcaaattttgagtttgatcatgtatttttttcatctctcaaaatataaaatcattgtttttgatatttttaaaaatatcacttttaaaattagattaaattctaaaaaaacagagtggtgtcattaaggaagccttccgtaagagaaaaattacttaggaatcaaagagtggacagttcaaattgggtttgataacattgattaaaatcttaatataatttttttaggaatcaaagagttattcaatatttttattatattaaataatttaataaaaagtaagatgatatttttgcggtagtaaaagaaaaattacttgaaaaagtaagatttttttcctcttgtgaaattttttcgtgagaaattaattaaaaacattcacagaaaatattctttcttaggaattttattttttaaaaattgataccaaatatggaaaattaagttttccaacttatgattcccggaaagtaaacaatttatctcccaccaaacacttcctaaagaaaaaactaaaaaagtgatacaaaaagaaaacgctggcagacattgggccttgaatgcgttattcacctattatcaatccaggtccatagaaagaagcagttcagtttttccggattcggattgggttctcattttggatcttaaccgaagcacactccgttacgtacgacgcatcctaatagcattggcggaaaccaccgttcgacgccggagacacgatctgtttcttcctctgacttattctcttcaggtaattaaaaacacttttctttctccactgtaaggggttgaatttttagaaacggttctggaaactctgtttgatatatgttagcatttactctatagtatagtgttggaatttgcaatttttcactacggaaacatctacatggataggaaatagaatgccaagatgttcacggtaaatttagtcgagaacaatatctaaactgtttttcatgttctgaattggaactttattgttattattattgccggtaaaaaagtacgttgtaggtcctcagttttcgattaaaattggccatgattctggtatggtattttttataattgctgaattctggtaatttttcaactttaaactggttgaaatagtttgattgatattcagggtgtttgattgtgtttataatctggggtagtttgatcggataagcttttctgataatttttttttcagtttgatacacaaatacctgtttttctttgcttgatgaagtttgatttttagataatttgtataactactgaacagtgtaggtatgggaatcagtaaaacagaagtaaacttgaggaggttgcttgcagctgctcctcaacagcaaaatcaagcaaaacttgtgcatgtaagtctgaagataaaccttttctaattttattgaaatatatgttttattaatttagattggcggatagtgtgtcttaggacggagtggagaaaaactataagtttggtgaagagttagacacgttgttatctttatgttcgagacggtccatttttatttcttttcctcttcatttccccctccttctttcaccctttttttcttttatcttattttcttttcttttgacttattttccctttttcttcccctcccccttccttttttttcaacttcctcatatctgtcattgggttcatctaccatcgaccccaattaacttgtgttaaaggtgctgttgatgttgatgttgatatattttattaatttagtcatttcttaactctggaaaaacataattaatcatttgtcgatttttggattttgcagtatgttgctactttgcgtgaacaattagaacaattggctgaagaaaggacactggaaggcttaccaaggtattgtacgtctctttatttaccatctgatacacataggtgtcatggaattataattgaaacaatataagtgcattcatttgtgtgtataaatgctctgctatggttatgcaggatttcaaaggctatgttgaatgattattcagagaagattgaagccattgcttccaaattggttaatcatgtggtgtgtatttgttactcgtttcctctatttctcagctcttctgcttatgggttcttaacacattttcactttggatcataacttttgttcaaaatcattttaattttttaactccgtcctctttttcacctaatcaaccaaacttttaggatttattacacaacggagaaaatcatattacattcactatatttttgttatacaatgacagtaagatattaacccaagacatcatgcaaactgtccaaactctcagctagtggtttataatatgttcactatagcatgtgaaaagtgttgcatttgatggctgtatttttgttgactttgttggaaatatggaatgcatcatgaagttgtaagctcctttttggttttttcaatttatgtaattttagttttggcctaataagcacaatcattcaaccacagtttttttaacccagattgacacacaagtacccaagaaggacttcgaaaagaattttgttaaagaaaaacattctgaaattgaggaaaaaaagcagatactcctttcttctggattgagaagaaggcctgtgtaagctaaagttagcctttcttactactatgtgtattttgtaggctattttactgttgctcatctgattcattggacagacctgcctcaagtacggaagataaagcgcatgagcctgctgagactgaccacacatcacctattaaactggatgctacagcacatgcacacattgaaaagcacaggtactgtttatttgagttgttatttgaagtttatgtaatggtggatccatagactctgtactgcttttatggagagtccataacctacaagctacaaaccttatgttcatatgtcaatttgtctagaacaacaaagtatatttttcttcaggacaagcaccaatgtattaaggtcaatcgttgatacattgttagtaatttaccagtgaccatatgttactagcttaatatgattaggattatatatatttgagagtttatatcgtcttcattgactagtcctgaggatgtttctgaatcattatcattatgataccaataatttccattaaatcatgtgtgctaatgtattagatcaataatttttatagtcatttactgtgctctctatatactctgcatttattgttatcacttgtgttttcatagtttttctgttttattcaatttttaatttagaaagcttcaagaagatttgactgatgaaatggtggttttggcaaaacaactcaaagagagtagtctcacgatgagccagtccctgcaaaatactgaaaaggtctcgaatctcattttcatttaatcgtgcttgtcttactgctaaacagttatatgaattggttgtgggtggcttgctttgcagatacttgattctacagagaaggctattgaacatagcttggcaagcaccggtcgtgccaatgtgcgagcaacggcaatctactcggagagttctaagacttcttgcttaacatggcttgtcatgtttgtcatgacatgcgtatttgtcatggttattcttctaatccgtgtcacagtgtaaaagaaataacttccaacataactttttatatttttttttttccatagaaatcgaagaagttgtcaatgtcaatatgaggaagtttataacaattcattcacttttatttaaccaacttaaccaactaaactagactctcttaatccttgtcacataatctaaattaaattgaaaaatgttaacattagttaaaaaaacattttttttttctcatgagaaagtgttttaaatgatcttttaccataatctctaatgtagtttattaactgtagtttttaataaaaagtttctatttattcatttctcaattagtctccttagagcactcaataacaaggctatccttctttatatataaatttaaaactatctatttctttattctttcacgttcattcttaatatttttcttttatgaagtggtgcatttcactctaacatatgatatattcttttatacttttaacttcaattcaacgattttacaaattttcactgaatattagaaatcaattttaaatacatgtgacgtatatttaattaaatgactactagtataacgaagcttatattatttattgatagtttgtttgctataattaaaataatggttggattatttaataaaaaataataatggttggattctgttagattaaaaaaaaagtgaaagcttttaaattaaaatcaagaaaatcttaactaatattaaggttatgacgttatgtttgacccaactttttaattctattaaggtttaaaaataaagtaaaagtttcatgaacatttttatttttttgttttaaaattcctttttaagttaaaactgtttggtaaaaaaaagtttagatttatttaaaactaactgcctcactcaacaaaaaaatatattgataaaataaacgataccaaaatgcacaagattgtaattaaaaaggtgaaaaattgaacagggtttctaaacaattgagcactattttcttctcaattttatcttccgattccggtcacaccacatctaaataaaaggctaaaaattatactcatatatatcttcagattttctttccatctagcatgagcattgcctaggccattgcttatagataagcaaatggaagatgatgttctgatattatgagatattatgcttttgtgtattttcaatgtaggcaacaaaaaagtcttatataaagtttacatgcacgagtagaaattctgctaacaaaataacaaatccaactaacagattctatatctataacgccaaataatataatatctataatgtctctttgactttttcaagcaatacatatagcttttggtgtaatgcgctgctgaggagaaaatccagaaaacaatgaattaattatctgattagaaaagccatatatgatgagaatactctgaatctcaagatagatcaaacacagttgaataattttatgtaaaattgccatgcaaagtgtaaaaagtgctcagctaggtagcttctcctttctgataggattttcctttgtagttaattaaattaaaaggtgaatggggatcattggcttccctcattaggaaacaagatggctaagaaattgtcataaactcaactcactaatttaatttcttctttgcatatatataagcttgatttatgtgttccctgaaccatgattctgccaaggaaaaaatgaactggaaggtacacatagcaaactcttgtatagatcatcataataagtttattaaaggaaaccatttataattgggtgatgtcaaatttatcaaattttcctgcaccccattacaagtacattgccaattgccatcaaattattatatatacaaaaactatgatcagataatagagtcaaagacgatcgacaagaaaattattgggtccgagaaagagaggaattaagccatatataattactaataaaacatgtattatgcctcaaatttatagtgaccataattaagcataacactagaaactattccaagagtaaacacaaatgtaatgtaattactaagcaataccacagaatgaagcttacactgactactactatatccctcctcctcctcctcatcaatgcatgtcttgcgaaattcttctatgccgctggggccacatcaatgacgccattatcatcatcgtcatcatcaccttcatttgagatacaaaagttgtggccaaattcatgagttgcagcccagtcattgcccaagggcacaccatattcttccttgcaaataaagaccaccattgttacacagatatatgacagaatgaattatactataaaataaaagactgcctcggttgtgacctaggttacatttatatatacattagaaatttgtatttttaaaataaaagaaaagaaaagataaaatatagggtggctagcttagtagcttttaatatattgcgaaatccaaattggatcattctaccctttacaacacataataacactttttataatttatttattttcttatctcttttcattccattgttcattttatttatctctcttcctattacttcatattaacggttatatatatatatatatatatgtttctctcatttttctttctttcaactaatgggtgtctgctaattgtttttgtattgttttatacttttgtatttttctttgtttctctcttaaatttctgaaacaaattgtgtgagaatagcatttctcttggagattttctgaaagataagtttgcctttttgttctttctctactaccaacgagctaggcacttttaattttgttttcttgttagaattcaacgttctttatgagtgcaaaggaggcaatggctgaggtggtgaagcttctgaccatacaaatttccatggtggacaaaacttgaggcaagctcatggcttcatgttgctaaatgcatttaacatgtggagttaagtgctgcacacacgcttgagcttcaccgtcacatgcacttggatgacatggatatgccaaaaacagctagcccacgaaagaaaaggtgaatgtaaatgccaaagggtaaaaacctttacaacataggttttggccaaacatgatcatttgagaggaaaagaggattttcaaacacgtgtgcttcatcattcatttctccctcgtgactactcaaatatatcacacatttgtggcttaaagcgactgggttaggtacatatattttaattttattttttatgagtagtagtggacatttctttcctctaaatacattgctaacatttattatttttttacatgtacaacaaatcttaaaacaaagaaatagaaaggaagaaaagtgagaggagagagaaattttaaaatataataaatgatatgataaagaagatagacacataaaatgataatgatagtgtataaattgttgtacatatatcatatctcaaaagtgatgttagatttaaataaatctaactaattttgctctatttaatgttatcattctaaaatattttttatttaatttttaatttttatttttaatgattatttttttattcatgataacaagtttcaattaagaatatcttagaaataactttattttttttacttgaaattagtaaatttcaataatattaactaaatttgttaattagttatttttacttacatatgagtctaaagagagtatttatgtttctctttttcttattaagtgtcatttaaagtgaaatgtgtcatagaaaaataaaagtttatattaaactcaaatttgactttaaatcgagtcatttcttatcaagtaatctaacttgactaagctagattcatttataaccttattaacaatacaagtaatttgtatttaaatgaatatatatttagaagacttgtaattgaaccaatttggataataataataataataataattaaaccataaaattttatatatttcaaattatgtaaatgataaatattaaataatattttatatttttaaattaacttaacataataaatttaatattaaaataatttaaaattgaaattgagaagagtatgccattatttaaaaatgaaaatcagaaaactataattatttctattattttcatgtatttataattttatattatgtgagcaagttatgtgttataatttattttatgatataggagtaaatgataaatattataaatataaaaatatagataagttgtatttgttagtagttttaatttatattaagtatagataagttcttcaaaaaataaagttaatttacaagttaaataatccggaggatgatgagcttattatatgggcgaattcaaaataacagaacctttaaaatgaaatggacatatacaagtatgctcgatcaattgggctataagccagtgtcataatcaactcaatgatcctgttcaagtttcattatattataactaatcaaggattcaattgagaaaattaaaaatagcatggccagattgacaaatgagaactattaaggtaggttttagtttgctattcattttatctatattattttataaatgattacaaaagtaacattaattttactttagtttttattttcaaaatatacaaaaaatacttgtttcactacctttataaattcttgaaatcagaaaaacaacttaaaaacaatataccatttttttaaaatcataatcaaaagtatacaaactaaaataaaaagacagttttgggttttctccaaaattaaacgggatttggcagagaaaaacttttacactaattaataaaaaaaatgaattatccttaatagctttatttgatctttttaaacgaataatagtcgttttgtttatttcccggaccccttgtgactcaaataaaagactttccctttcttaaaatatctctcctctcctcccatcccctacattagtcttttttatgtattaggttttaaactggggtagtatcaaacgccttgtaagtggcttcacaagtttgcaacagtcattaatgaagtcttgatccccagtcaaataatgagacacaagaaattctaaagacccaacatagaattgttccctatttacattacatccttcagcctttcccatttccatcacaagtgagagaaagggatattgaaaatcaaaccatttacataaggaagaatctattcatacttctttcctttgagctttcccttggggattttgctgagcaaaccagtatccagcttctgatagtgattttgcatctgatcaaagaccttgtacacaaagttgtcaacttgatcctgatacctttcatagagaactgggagtgtatgtgcagcaacaaaaccttagacataacataatagaaattttagcaaatcaggtatgacctgaaaagtcaaactagaaggaaaaacatcatcgttgaacttctaacaggtaccatatcatccatctgaacttcaagaagaaaaagatccactatcccacaaaataatatacatcaacatacactaatatttgatttcaaataagatttggtaattgaggaggcatattatcagaaaacacttaacaaggcatacatttgtgtgtgtggattgtgttacaccatccaaactcctgactccagcatcttaacaggaatttaacatctttcaaatcgtttcctatgctacacaattatcgcatagacagacaaataacaagcttttgaaagttaatatgtcgttttaatcatccttcatatccatcatacaagcacaacataaggttggctttaccaaatactaatataatacaatttccataatttcaataattcacatttctctgagcaaatatttgtaggattagctgaaattttgaattatatttttcaaactttgtctgacttaataattcaagcagacactctggtcaacacattctaatctatatcaacagatgaaaagaaagcaggtctctcaccaatatacatgacagtcaaaaaattgcaccaactcccaatcacagcaccagcccataagcttactacaacctggggatgttatagccattatcacaaattccacaaaaaaagcatatattttccctttgcaactaaatataaatttaaatataatttatcatatataacataaaaacaagttataaaataactgatggcaaagtagaaagtgcatcatcatggttgtgcatttaaagatactaaatacaacccacccacattgattctttgtcatataatactactccaagtcatgtaaaacaacctatattgacccttgaagcttataatttaaaatccttgtttccccaattcaattctatcatacctccggctggatgtcagtctcccccacccccaacctacccacacccttcctgagtgacaactccttgtgttttttgctcagtaattcaaatctttggcaacaacaaagtaataaaatcaggaaaccacacaataacaaacaacttaagatcaaatgactcttagaagataatgtcacataaggtttagttgacttggcaagttcccacgaactcaagaaacttatccctttctacatgagtacaaaatagaaattcgaagaagagaaaaagcaattgacaattttgatgagatatgtcaataacatgtcacaaacagaagatgttgtagcaaacaaaaataaatggaattgattgaatgacaagtactatagcaaatactggtgtcagaaactgaacaatggtttaacctggaaactacattctaatttctaagcatgaacgtggatcgtaaataacaattacaatgaaagcaaacataagagtaaccatacaataagaaattgttttaggtttcctccacatgaaacatcttggagaaacctcaaaccacggttaacctcagcaccaactgcagttgcaatattcacgaagatatcatctgggaggacaaaacggggaactttagatggcttcctgtcacccaacagagaacaaagcatgtttaagctgtaaagtagcataatatatttacataaagtaagacatcaaaagaagagaagatgcttggataacctgctaaacaagctggaagcatttgtccaaataaactgtccaagcataccaagagccacaacaaagaataaaatagttaggaaattataattaagccattcaaaaagcacccatatagctgttgctgcggataaaacgctagcagagatcttcttgttcctccataacaagacatcagcagctgcatcattcaatggaaacccaaaaaaaaagtttagaagtcaaggccaacatgatagattttacaggaaattatctagaactaccatacattttccaccccctaaaatatggtgcacaggtttctggcgtccaaatagtctattgaattgggagctcactgagcttgacttgtcttcaaaaaatgatccagatttttgcttctcagtaagtgtttccacaatggtgtttaaaaggttttcagctgtgattttctcagacattgttcctgcacttctatacgaacaaaaaagaacatcacaaaatgttgcatgaaaatagcgatcatgcctatcaccactgcagcatcaatcaccatttataagaaaccagcacacacgaaatgagtataaagatacaattttctttttcccgaaccattaacaaaagagaagaacatactaccgacatcaagtcatactttcacaaaggcaaaaagttatctcgtctaaaatgaaataagtctaattggtctatggtcacaaaaagaaacatctctggcaattaattattaacttagcctatatgtatgtaaggcttaagctacatcaagtttactacttcaaccccattaagtctatttagtgtctgttgttttagattgttattgctgcaaattgggtcttaacttcatagtgtctatagcgaactatttagcattcttgataactttaattattatttttatgcctttttccattactgtcatagtcattccaatgcctgaatatggggctgattgagtttttgacattgtatttgttgaaatttaaaggatttgtatgcaaaaggaaaatggagagcacggtgaatcagtgcacaacataaagtatgttataatgagactctgagtgattgtgacacaaaacacagactaacacctcaatttactgtatttggttgggcagaaaaaagcgaccaaagagagaattatttgaaatattgaagtaaagagaaaatgaatttaactttttttttttcctcttatttcttttttactttcttttcttaattaaaaaacataaactgggaaagcagtaaagaaaaaggggtaccgcaagtttttttcaacccaattgagaagggcatgaaagaccagcatttgacatataatgagggatatgacgaatatacgaagaaattcaaagtttaagcacaagtgcaaatccctaactggagaaattttcagtgaattcaacaagacagattagagaaacgaaaaccagtacaaacgcaaaagtggcagcatcaaaggaagaagcagaagcatgaatttaatcaattaaaacagaaaaaggaatgattttcgtgcacaaaccagagaatggagaggagggtagaagcgaagtagcgaacaaagtactactgcaaaggcacaccagagacagacagagagagagagagagagagagagagagatgcttttacgttggtataatgaatggcagaaagaaagaaagaaagtgtaaaatgcaaaagttactactataaaatataaataaagtagtatttgaaaagagtttagtttcttttattttaactaaataaagatatgtaaaaaaaattaatatatctaaaaaattaaaaaaatgtatgatgaaaaataaaaataattttctgaaaaagatcatataattagggagtattagataataattactagtaattgtgagtaatttttaaaaatagttaaagaataaattaggaatagtaaatatatacatcaaatggaatgattgtttttattgataattatatattaataaaagtaggagtttttttttgctgaatttttaaaaacaaaataaaaaaatagggctagttggataaatttcggactatagatatttatagaaaaataaaaataaatactgtttttataagttaaaattaattttttcatgcgacacaagcttgtttcattttttattttttcctaaaaatatcaaatagacttatactactataaaaaaatagttatgaattaaattgagtttattaactatgaattgtcaatacaatttttttaacattgtgaatcagttaaaaaaatattatttatatatatttttttataaaattataatatataattgattgtaattgaataatgaaaaaattaattaataacattattgtatagactattttttattattaattttatattactgtaaatagattctatgctaattattttatggtttttttatttcttaaagtaatgatttaatgatagaaatgtgagttatcaaaaagaaaaaaaaagaaaatgttatattttattgaaaaataaaaaacaaaaaatgctattttatgttttttttatattcttttataatttatattaatattttttttattttcttaactaatatttgaaagacactaaataccaaacgaacaagaaagatagaaatgtagtatctcaataaagaactagtgataattgaggaactcagcaaccagccttcctttgcactagtcttctgaaaataaaaacaaaacacacgtgaagctccgtcatttcccatttgggatttttggagtccgagccacgccgtaaacaacagtgcagtatagtatactactattcttgagcaatgaccatctctaatgtttgatcaattgattgattaaggtttttttttttattatttattttcgtgggttctacaatagtactgctactatatatgttaaatttaaattttttaacaaagatttattttactattaaaatttttaacttaatttttaatttaactttgtgtgttctataattgatctcacataattattaacacttctgattaggcatgacaacgaggcaggacggagtcgagtattgcatttcccgtccctgtcctcacacccaaacccgctccccgccctcgccacgttttccgtcgggttttaaaattcatccccatccccgcccctgctggaggtcgggttttccccacctcgccccgctcccgctatttgattgaaatttaaaaaataaaaaaaataatataattttttattgaaaaatcggataaaaaaattaattatgtaataaaaaaataataataacaaattcacatttaaaatatgagatcataattttaaaattacaaaacaaaatcaatcaattcaattaaaaaaattagaaaataatatatatatatttttttaatattatttattacggggcgggagtgggggcagggtgggtatcaataaccccatatccgcccccgccccccacttttggctatcggagaaaatccgaactcaaacctgaatccgaaaaattcaattttttctcattaaaatcaaggcggattcagacaggtacccacgagtttggatcccattaccatgcctacttctgatacttgttgcaggtccttttctgttaattcctaacattggccatataatttttcttttctccttaccacatcggaatgatcttagaccaatttagttcacttgagatatcgataaatagcatatgttagataataccttatattatatgggttctactgtcccaagaattgggaaatcgaaatggcttattctcagtattttatttccacaaattattcctttattattttaattgttttattttttgtctattaacttaatatctaatatatttaacaacaatattaatgtgacattatattacaccgtcctagcggcacattcatactagcacgatattctatggtatgactacgtcaacacgcccattaaatatttatattttaagttaatgaagaaattaatattacacaattaaaataattaaaatcaattaataaattattaatttgagggtactaaatttgatttctttaaacaatatatctgatttgatcattataagtgaaaaaaagtgatcgttaaaagtagaaatcttactaaaataactagccaaaattccaagcaaaaattattaatcaacaaagttgttaagtatttcactctaatgtgataatgatccaaaataattagatcaaatccatgagaaagaacaagaaagaaaatttataaaattaaaactaaaaagataattaaacttagagaaatattaataatatattctctaaaaagatacctttttatggccttctttattattaattgaaatttaagaaaaataataaattttgatgaattttacttttgatttaataagggattttataatttagaataaattacacatattcctcttgagacttatccttattatacctaacctgatatccatttattttcacacaaaatcctttaatttttttagttttcgttatataaacctcctctctcaggcgtaaatcgttaagtcgatcctctttggaggaactcaaagtaatatacaaaaaaaatgaaatgatattgagcgtaataagagcaagctagaacaggagaatccgtataatttgctttatagtttttaataactttaaaaaaaataatagaacgtggaattgaaaaaaacacactattagaaactgtagctatgctcttcgacctaatatctaaaacacagcgcgattggaagttggtctattttgttttggaagttagtctttaattacctgaacataattttgaacaaaaatattaaaaaacaagtacttgaacgaatacaagatcatatatataacaaaaagtaatgaatatgacagtgtcttgtcccaaaatgggtatggcatgaggcaaatgagaatacgtgatacgacgtggcaccaatgagagtttctattaccttatcccacatcgacaatctaatccaattttcccaatcatcctcttccaaaatccaatatccaaaatcctcgttgccacataacacattgaaactaaactccaacaagttcctaccatagtctgaggtaagtgaacgagagaaagagatcacagacacagagaagaatggctgctacacaatgtttcttgcaccaccatgctcttaccacccctgccagtgccagatccccatcacaacgcatcatggttagcaccaagcctaaccaacttgtttgcaaggcacagaaacagcaaacaccacaagaagatattgatgtcagcccaatctctcgccggttagctctaactgtgctcattggtgctgctgctgttggctccaaagtccaacctgctgatgcagcctatggtgaagctggtatttcattgtctctctttttatgatcatgcaatattaaactcaaatgatgataacactcattagtctttggcttttgaagatgaaatactcatttgcatgattatgatttttttatactgtccactgcttgcaaagatcatgccatgcttcaggaaaaatatgttattttttggtgccatgaaaaatcgttgaccacctaaatggctagctgcaaattgatttgaaataatttctagcatgcatagtaactaaagtgttactataatctacttttgattttgtgatttttgtgaattgtgtactctttactacttagtagggtttaagatgaaataaattgagtgatcataaaccaccaatcacatggatcaactagtaaggggtttctccagcttaattagtgatctaaagttcgaggtctaggtgtgcagttgagttgaatacgccaaaggaatgctttactgccgataatagtcttactcgaatcgagcaagattgccttccttctgccgtagatacctgtggtctatgctaacgaatatagtgattataggatacaatccaagggtaggaatttacataggtcttgatggtggaagtcgataacgaaatcaattcagatgcttagactattttgaaaaataaggtcgctcaaaccttgtgcagaaattataattgaaagaatggagttggcaaagattattagactctaaaataaccatttggtcataaagtcccgaatagcgtgtcaaggaccagcttatgcttatctcaaatgtataagttgttaggtgggagttgatccctctaataataatggggatgacatgatttatttgaacaacttggttgttttgtttgcagccaatgtgtttggaaagccaaagacagacacggatttcctgccatacaatggaaatggattcaaactatctattccctcaaagtggaacccaagcaaagaagttgagtacacgggtcaggttgttagatatgaggataactttgactcaaccaccaacgtggttgtcaccatcactccaactgataagaagtccatcactgactatggttcacccgaagagttcctctctaaggtaaacctgttttaaactagtacttctgtttgttttctaattaataaggaacacttatatatagccccattaatgtacagtttttatgtttctaagtaccaacagaatcactgaaatagtgaccaaatttagtaaagaaaaactgtttatatcactaattctggcaccactaagttttagtgacaattttttttcttcaattgcatatagattattcccttactaattttaacctttttagtatacattcaaaaagaaaaatggtaatatatgaatttttgaagacagtgacaccagtttctactttctggctgaaattcaagatttggtgtttcctcgttacaggtggattatttactaggaaaacaggccttcttcggcgaaacacaagctgaggtaagtgattgatgatcaaacacgatcgaatgaatgcgccaaatatcatcttgcatgccctaactgaagtctgaacttgaattgcacagggtggttttgatccaaatgcagtggccacggctaacatcttagagactgcaacacctgtgattgacgggaagccatactattttctgtctgtgttgacaaggactgctgatggagatgaaggtggcaagcaccacataattagagcaactgtaaaagatggaaaactgttcatttgcaaggctcaagctggagacaagaggtggtttaagggagcaagaagatttgtggagagtgcagcaagttctttcagtgttgcttaaaaaacttcaatagcattttatatatatatgctgtgtgtaaatcaaccttttaagtgctatctattgtttgaagttgtctaacctcccttttgtccacgagtttcataattttaagagacttggttggattaagtatctgaatacttaatgtctccttcgttaagctgctacaaggagtatgcattttcgtaacaaggcttaaatttttattcgagaaacaattatctcaaggaaattaaaaagtgtgaaatgttgattttgaaacgtagttatttgaaagagaccaaagaaaagaaataagcatgaagaacaattaatggagtcttctaacccaggactgcataggacaaaacagaaattgataatttataaggacaaaacttagcgcagtttcttaagggttgtagatgctgttttccattcagaattggcgttttacattagtaatctgcattaaattaaagatcaatgtagattactaaggtgaaactcaaataccaatgaactgcattgtgttttgatcattccaatatcatgattaataggaaccaggtttgatcattagtctgtctatggcatggtctaatggtttgattattgggagccactgagccagtttcgagacaaggcaatagctaaacgtagcctgcaaaccataaaagttgtagtctcttatccagaaaataaaaagaagtgaacatatatcaatgatgtccataaaatttaataaatttgttttacagaagaatattaaatatatctaaatataatcaattaaaataattaaaattcaataacaattcgggttactaatttcaattattgtgattccagttaactataaagtgagaaatttttaaatagaggaacaatagtttattatcttcacaatagaagaaataatagtgttttaaattattattatcctcaagaaagtggaaataatttattatccccacaaaatcggagatgagaggtgcaagatagttcaaatctaatacataaatttttatgattgtacttatttatcataaaaagtgaaaaatatttatattctataattaaagtaaatatatataggatccaattcatttggttcaacaggtacatgatgcataaattattataaaattttcatattgtctttgattcgtacgataaaaaaaatacatgtatatcaagtgatcttaataaaatcttaaaaatttgtttaccgaaaaatattaaatatatctaaatataacaaatgttagtagaataaatctagacacacaaaaaatctagatcccttattaatgatcacactggagtgtaaggaatttaaataaaggaacaacagagttgagaaaattatccaaaatttaaaatttaatacgagtgagtgaaatttaagaggtgcataaatgtgacaaaatgggcccaatctaaacagcctataaataaggctgggtcgggttcttaaatttagtccgaagaaaattgagccaatttggcctaatttgacggattagatcaaatcaatgaaatgtatgcttgagacctactgacttatttaatctgatatttttttcctttataaaagttatataaatcaatttcatgaaatgtgtgctgcaaagaaatcaatttcattggctaatgaatcccaacttacttactgtttgcgcagttgttatttttcttgtaaattatatatgaactattgaggtaaaatgagtcaaaaaactattgaggttatgctgattaatattgttattatagagttatacaatatattatagattaaaatacttttttaaaaaaaaataagtgaatataaattagtaatctttagaatatttatttttattacaactagttatttggagtgagtggaaatatctgacacgacactactcaatgatttaaaatgtccacgttactcattccttcctgaatatagatacatacatgtacgactaaccgtgccttaattatcccatttccagctaagttttctcattgtttatacacagcaagaagattagattatgataagaaagtttaatgatcattaataatataaaatatttttatattattatttaattataatttattgttaacgatttttaaaataattattataaaaaataataattatattatatataataaattataattaaatattagtgttaaaaatcatatatacataaattaaaataataatttcaaatttattatctcttcattcactaatacatccaatataacaataatttaaattttttcttatttaaattattttaacaatatgtttttatctaaaaaatcataattcaaattcaagttatatcttaaaaacaaatagtatggttttttttaggctgagagtgtacaatcctttactcttattataatattgaaacgaagttatttgcgtgtgaaaagagaaccgagaagggaaacgcgtgatggtttaagaaacaaggaaggaaaaggcatataccaatcaccaaaccaaacgaaagtgtatctagcaaaggccaaagggtagtgattcaccagacacaagggaaagctataaaagagaagactataaaaagaagaaaaaaagaagagaaatccagtagaatttagttgtaaaactaaaatgtattggtgccaattatttgccaattttataagttattcatttttgtaggataaatttggctaattatattccgctaaccaattttttttcttcattcacttgaactcgtatacacataattgataatataaaataattatatattattatctaataataaatcatgattgatatgatatttgtgatgattatcatacaagtcataaccatattcattatagtaaaaaaaaaaacctaaatgaatacaaatattcgtagttataattaaaaaaatagtattatattatattttacgtatatatgttatcattctttgcagcacaagcagaaaaggagaaggtttgggattttagagcgtatgtggtttttgttggtaactgaagagtgtgtggaagcagaagaagaaggaagaagaaggaatcggcggtgttaaactgacgatcgcatctcaaaggttggttactatcgttgctttgcttgttcggtaagtcggtggatggatcatcgccgtctttatcttcttctccacttattggatctgccacttctgattccgattgttctatcttatcttatttctgttactcttccaattttctttgtttgtttcctcggaaaatgcatatataatttgtttattattatttatttatttattttgcaattttatctgctaggcgtcacgcaatctctcttgtttcgatagatgattataaatttggtagaaacattgtgctttcaagtaactaagcctggattcttgcatcttgcattattgttattatttttattgttgttgtttcaatttgaggaatctgtttgctgttttagcttctgttttgtcaggactcagtttcattgtacttactgttgctgtttctgttttctatgcatacatttttttttttaatttgttgtttctatttgtttgcttgtgttatttgttatgctaattaagtttgtgttagtttctatacagagttttattttctccactgacattttctaagtttatgttaatttgttgattcaatttgaggaatttgtttgctgttttagattctgtttctcaggtcttggttttattgtacttactgttgttgtttgtgtttttctatgcagacatttttttcccttgtgtgttttcagaggcattttcttagttgtatggttgtttgtgttgttttctcgcttctgaaattatatatgggctaagggggcacttttcatgggaggtgtggaagatgaagaaccatccatgaaacgaatgaaattatcctctaaaggattagttggcttgtctaacggttcttctaaagagcctgttggaggcttgtccagtgacttgatggctcggcccctaccatccaaaggggacgaacatgttgttggttccaaaggggttataaagaaagaggaatttgtcaggataattgtaaaggcattatactctcttggttacggaaagagtggggcacatctagaggaggagtctggaatacctttacactcacctggggtaaatctgtttatgcaacaaattcttgatggaaattgggatgacagtgtagccacattgtataaaattggtctggcagatgaaagtatggtcaggtcagcctcattcttaatattggagcagaaattttttgagcttctaaatggtgaaaaggtcatggaagcgttgaagaccttaaggacagagattgctccactctgcattaatagtagtagaattcgagaactttcttcctgcttagtttcaccatctcctaggctagatattctaaggatgaggtctcgatcaaagcttctggaggaattgcagaaactgcttccccccacagtaatgatacctgaaaagaggttggagcatctagttgaacaagcccttatcttgcaacaagaggcatgcccatttcataattcattggataaggagatgtcattatattcagatcatcattgtggaaaagatcagataccttccagtacattacaggttagaaatgatgtgcctaatagatattgttgacttgttaattagtagtggtagtggaagcagcttcctcctttctgtttgcctattgcagactagaactctgttcgttagcttttcttttgcatttactttttcttgattataaagttatgtttactagatttgtgaatgctaaactgtggcatcttggaaatggatgtgaatatcatgtggttattgttaaaatgcacttcctttcttgtaaatgagatttatgtatcattagttggattcaagggaggggaaatgagaaaaggtaaagaatttgtcttcagttccattgatccattcttttgctatttctttacaacgaccaccctgtctttactttctatagcatgagtcgtatctatattctgatgttattttctgattaatattgcaacagatattagaagcacatgatgatgaagtctggtttgtacaattttcgcataatgggaaatatttagcttcagcatcaaaagatcaaactgcaataatttgggaggtaatatttgatactgatctgagaatttacattttgccttttctgttctctttcatattttttatatgaactgataaatgtggtttcattgcttgtgttttgattctgtcatcatactgccaatctatatcctagttgtaatgtattacttctgatacccacccacctaattgatcaagacacaagaattgcactctaacacacacacacacacacacactaataaaacatggcttaatgctatgaaattaggtctcactttttaaattttgtttgaataggttggcataaatggaaggctgtctgtaaagcatagattatctggtcaccagaagcctgtttcttctgtttcatggagtcctaatgaccaagagctcctcacatgtggagtggaggaggctattaggcgttgggatgtctctactggcaaatgcctccaaatttatgaaaaagctggtgctggtctagtctcctgttcatggtttccatgtgggaaatatatactttgtggcttaagtgacaagagcatttgcatgtgggaattagatgggaaagacgtggagtcttggaaaggacaaaaaacgcttaagatatctgatttggaaataacagatgacggggaagagattctaagtatttgtaaagccaatgtggtactgttgttcaatagagaaacaaaggatgagagatttattgaagagtatgaaacgataacctcgttttctttatcaaatgataacaaattcttgttggttaatcttttgaaccaagaaattcatctatggaacattgaaggtaatcctaagcttgttggcaagtacaaaggtcataaacgcgcccggtttattatcaggtcttgctttggtggcctgaagcaagctttcattgctagtggaagtgaggattcacaggtatgagtcttcaattatcattgatcaaaatgggaaaatattcatcaagtgtaatttttataatttgcaaattgaaagccttgatgtttgtatctctgttaaatgtttttattttttaaaagctgtctcaataatttgttaaaatgttacttttcttcaaaataagttcaacatgcacttgatgcaggctatctatcgagggtcattaaaatattggcataaaagacacatgaaatggtgctttgtgctctgattgataaactggacatctttataaatattagttgaatgaattcaacttcaactattataatgttcaagaatcacgggcttctgtattatttattctaatttatcttggcttctgttatttattctaatttatcttgataaaactaggagcatcttgattgataatgttagaattctgcttgatatgctctgtatttaaatctgttggagttcccttttgtattcttcttggccatcagtttgtcattataaccccaaagaaaatccacatttactagtttctagttgtggtgtttagtagattttccatgaggaatacagatacaagatgtatcttagattgatagaaatttagcaggtattaggtatatttatatctaatactaagccgggaaataaaaaaacgcagccgctaagcttctttcttttggatatgaaacaatacagcatgtaggacccctgtaatgttattggcattattaaccaaacttcttgtgatagtgaattctattggataattttggagaattattaaacttttattcggtatctttgtaggtttacatatggcacagaagctcaggggagctaatagaagcattggctggtcattcaggatctgttaattgtgtgagctggaatcctgcaaacccccacatgttagcctcagccagtgatgaccgaacaattagggtatggggcctaaattgtctgcacaacaagtaccaaaatgttcacagcaatggcatccattactgcaatggaggaacttagtatgaccaactcattccaattgatttctcttttttcttatcattgcaattgtgtaaatactattactattatcgcaagtggaccattcatgtcaaacatgcatgtgacttttcatatatatctcataataaatccgtgttccattaacgtcaaactgcgatgcgagactttgtcttgttttaacaagtatcactgccatacgagggtttgctataataccttggtgaggatttctagacattggatggtggataaattcaactcaattgtttttgacagaaagaactccttatgattgagtttgggttctctgtttcccgagattcaaatttgagtttggggttgtaaatactaaatacctagcctcaaattggccattgttaatattagagttaggattttgttctcacactctcatttctcgtaataattgaaaatacaaattattataatgattaagtttgattcattataaatgaaaaagaaatgttgaaagatttttattttcttaaacaaatccacccaaattaatttcgattacttgaaacttgacataagttttagatttgcggagttctattagaaaaaaagtaaaaacactctcaggtaatgctaagagtaaatgtttttatctaatgtaactattagggctcgaaaatatatttaactaatttaaaatgagcatatgaagggaaaaagttaaagcttattattcaaatatgagcatgtgaagtgaaaaagtaaaaatatttattattcaaatacgattgactcattaaaaaaatgtgacatgtaaaaacacacgtctattgttgatttaaaataaaataaattataaatataattaatttaaaagttttgttaaccagtgttctaataattaaggaacaaaaaagtttttaatgtaaaaatgataggaaaacacaataaaattatgcagagcgcaattttatgttgtccaataaaaaaaattatactcttaatttttatctgttgttcttaaaatattaattaactatttgtcttaatttaaaagtaagtagatatactcttatgtttacactttacatacagaatatattttagaaaagttagaaaattagatacttaaatgtaagcgtacagacacggaagggttaaaattattagacttctaactaagtgattaaacatattaatattaatatgttaaagttaaggttgaattatttaaataatatttaaattcaatttttaataaaaataataattattaatcagattttacttatcttttaatcaaattttaaattagtcaatatccctttttcttagtcaaccaaggattaataaaaaaaaccattagaccctctcaacagagaaagtttgaaagattattgtgcatttgaatgaactagggatgtttatagctttcatgaacatgtcataacaatttcttttggtcaacgaaggaaaagaaacaacaaaaagaaaattacactctaaggaaaatcagaagcaaaatatatgctaataagaaaccgtgtatttaaagtaaaaataacaagcatctacgatattataggaatttttttccttactttaagtgaaaatataaaagtactactgctaaaaatttaaaattaaggaaagagaaaaattcttaaaaaatgaaaaaataaccacttgacatgtttgaaagttaacaactaattattttattttaatatcagatatttagtaaattagtagtgtctttcaaacacttaactcgtttatttccaataaaaaaaattaaaatagttgcaaaaagaacaaatacatattttttatttataaatacatataaacaagaaggcatttacctagctttcaaaaagaaaaaaaaaaggcatttacctaaaatggaaaacaaaaacagataaaatggaacagcggagaaagatacgatatacacgatgacggaaggaaagcacaagtactagctagggcttaactttttatttggatgtcggaaggtttttagtgtttttcttccaaagttaaatattgatccctggttatttatttataaccatattgtcaagtaatttctagaattttgccaattattaattttgatcaaagaaattaatttgatggagttcttccattctaattaaaattcgaatcgagaacttattaaaaaaatcagaatctaatattacttaaattaataatttgttgattgctaaattaaatattaatattaatctaaggagataatttattttcgataatcttatttccttcacccgaaccttgttgcaatgcaaagccttataataatataagtgtataaggtttaaaaatttaacatttaacagagcaaagagcaaagacaaaagtagaatagcagtagctgcagctgcgcttgttgcatcaagttacccactggggatttgttcaatggaaacgacgaccaataggaacaatatagggaagaagaaaggagagccacttttccgtcaaaaccccaaagttgatgaagtcaccaggattcgcatttcccagattctagaacacttccgagcttccaatgatgaaggtatttcctcccccttttttcttcaccatttcatgcacaaaaaacacaactttctcgtcggaaggattatgatttttgcataactatatccattcatgaaatctgggttttgattatttagttatttatttgctgcagtgtacaagtttgatgctagtttgtccaaccaagagcgtgcttgggtgcatcaaatggccctcaaaatggggtttagatctagaagttatgggtgagtgttaagggcagcgcatgtaaatttgccacttttagttaaatctgtaagaattattattgtcaaaattcttaaatggaatagttggagatggaatgaatgcttcagatttgtgtaattgttgatattggacctgtgttttgtgtaggccagggaaggaaaggagagtgtgtgttgaaaaaatgaaaaagaaggttgacacggataacgggtttggaagtcttcctcctttcacattttctggagaggcaaagtgggtgttgggtgatttgtttgctcattatccacccggtgatggaaactcgtgggagatgatcggaaaaaatagtgacgacactactactgagggaacaaaacagaggccggatgatattttcagccggccctctatgtccaaagctgaaattgctaggagattagaagctgttgcttctagaatgaacaatgtctctaacttgaaacaggtcctccttctttctctcctttcaactcctgacatgtatgagttttgttggtgaacctacatatatgaattttgttgcttagagtttgcttcaaaataagggaactgaatattatttcactagcaataaaatggtgcaatggctagtatatatatatagacgaacaaattaggttgtgtcccatgctaatggctgatttattgtcacaaaatgttggagttacatattttatttggagttcatcaagtacaatttcaaccatgataactcacaaaccctttgtccatggcttagaattttgattttgcccctgcactcaaccttgcaactatatttttctttttttgcttctccatgtgaccaaattaccatccaagaacatgcaataccatgaggtggaccttttttttatcaatagtggatcctacgtaatctgcatttgtgcacacctccatggacaactttcccacttgtatgattaataggccactcttgaactattcttcaaatactatagaatttcattcattgtctataaatgtttctcatgaagatccatagttatcaatcttggatagcgacatgtagtgcttgtttgctatgtgtatggcaaatcatttgtctgtgcaaagaatgaaagcaatttgttaatcctgctacacatcagaatgatgttttcttattattcctcttctgccatatatatagaatttgcaaaagaatagtcttgttattgaattatttgtctgatttccattctcgcagatcattgaagggagatctaagcttccaattgcgtctttcaaggattcaattacatcaactgttgaatctcaccaggttaatttaaaattgcctttggatatgcatctacttggtagcttgggtgctgatggttgcattataattaagcttatatgattcacattgacatgctaaatatatcaaataacatagttgagtaagattttagttttagtgcatttcaacgtgacaattaaattggatttgcagattaaatttttgcatgtgttttggtcttaatattcctttcacgtgtttcaaagcaggttgttctcatatctggtgagactggttgtggaaagactacgcaggttactaattctttgttttgtctttagtatggtacagctacatttacatataatttgtttgtgactgtttcaagatgatcatttttaggttgtatgttgatatttttataattggtccatttagtatgtatgcttgtgatatgactctgcacccgtatttaatttttgtattagtgcacttgctctttttacccttaatataaaataattggctcaagctttgatgattgtggacactgataattttttgatgctttgtgattttgggtttcacccatctgtatttccatcattgtatatggaccaaggtcttttagtaatctttctatgctatgcaaaacatttatctttctcttttttttttttattgtcctgtttaactttatattaaacatgattcaggtcccacaatttattttggatcatatgtggggtaagggagaggtatgtaaaatactttgcactcagcctcggcggatctctgcaacttcaggtgtgtaactctttcggacttaaatttcaatgttccttttttagtcttaattgaaatgtgtttctttcaatgttccttttttagttttaatagaaatttgtttccttctgctgtttctatgtttagtttccgagagaattgctagtgagagaggagagactattggagaaaatgtgggatataaggtaattttgtttatgtatttttggtgtagtaatggtactctgatcctttatttgaatttattttgtatagaaatatttatttgaacattgagcattgttatcataatcagactagttttttgcattcgtgtgttacactcataacacaccatgtttttattgataccgaggaggaaatctataagatgtcattagtaacgaagaagcatgatttttctcagcatgatttttctcctgtcattgcttcaatctacaaatatcttttctattttcccatatcactttctttcttacatagaattatgactttttgcccttcaacattcaatatcctatgttgattatgccagtcctttcctaagcactggtttccttgcttcttatagtagcacattgctagttttcctagtggtttacatctcatgaacatataattctgtggcttacattttaaacaaaaaatccagatacgattagaaagcagaggtggaaggcaatcgtcaattgtgctatgtaccactggagtggtattaagggcgcttgtttccaaaggttatcattcgtcaaagatagggcgtgtgaaggatgatatttctggcatcactcacataattatggtacttgtaaattatatttttatctttagctagagcataaactatggtacttaatctttggtaaatacttcttctataccttattcttttgagttatttggatggttaaaaaattggttatattaggtatgactggtaagttctcaaataaagtggttaattgaaaattcaaattgactaggaaaatctgttagaatccgagacattttttttttgaaattgttgtaaaattaggagctgtttggtttcagaaaatattttttgttttttacttttaattacaaaattggcacttgtttactttgtttcctattttcaaaagtttgtataggaagctatgaaaacagaaaataatatttggttttcagatgggtctctcctgcaataggtatttgtaatactttgaggggaagtatactttgaaactttcatatagattattatcttagagattttgttgtgataagtgagaagtgaattcaaatgtcttcatatattccctcttcatgaatcttggcataagaggcatttcctgcatatactgtccttggaaagtatgccttggcattgcgaagcatatcctgtgcatcctttcctcggaaactatgcattgcaaactaaggtgacattcattttttgttcaggatgaaattcatgaaagggatcgatactcagacttcatgttggcaatcatcaggtataccattgaaaggaacctattggcctttattctatagtgtggtatatttaaatacaaatgtataaatgcttgttgcataagtgaggagaacattgtgctgtaagttaagcttgttcgagatattttgcacctattagctttttgggtagagttgagtcgttccttgatgactgcaaatgccttttttttaaccacaagtatgtggaaataacttactgatatatttagtcctccctcccaaagaagaaagattatacataagattactggcataagaggtttgtctggtttttggactaatatctctaatttttggtaatttatatgcagagacatgctccctttatatcctcacctacgtctggtcagttcaatcttattacatttatatctttttgtctctatttctctgtctcctgtcaagtgcttatttaatttataattatgttatttcccatttttaaccttctggtgctctaatattacagatattaatgagtgctaccattgatgctgctagattttctcaatattttgggggctgcccaatcatccatgttccaggcttcacttatccggtacctatatagtcgtagattgtaaattaactaatactttatcacatattacttactacaattgtctatccaacctttcttcaggtcaaaactttctatttggaggatgttctttctattgtaaaatcgaggcatgataatcatcttgatagtaccacatttagtattccaaaaaacacttgtgagctaagtgaagaagagaagctttccattgatgaagctattagtttggcttggtctaatgatcagtgggacctgctattagaattggtttcttctgaaggaaccccagaactatttaattaccaacattctttaactggtcttactccgttaatggtgtttgctggaaaaggtagagtgggtgatatgtgcatgcttttatcttgtggggcagattgctgtttaagggacaaagatggaatgactgcattggagatcactgaaagggaaaaccaaccagaagcagccgaactattgaagaagcacatgtataatgatttttccaactccatggaagagaagaagttacttgataaatacctggcaacagtcaaccctgaacttgttgatgatgttttgatagagcagctgataagaaaaatatgtattgattcaacagatggagggatccttgtttttcttccaggctgggatgatataaatagaacacgtgagagattgcttgcatcatcttttttcaagaattcctcaatgtttatgctcatacctctgcattcaatggttccaagcatggaacaaaagaaggtttttaggcgcccacctcatggttgtcgcaaaattgtactatcaaccaatattgctgaaacagccatcaccattgatgatatagtgtatgtcatagacaccggacgaatgaaggaaaaaagttatgatgcttataacaatgtgtcaactcttcagtcatcttggatttcaaaagcaagtgctaagcagcgagagggacgtgctggccgttgtcaacctggaatatgctatcatctatattcaagaactcgagcagcttccttgccagattttcagattccggaaattaggagaatgcctattgaggagctttgtctgcaggtattcgatcttccctgattggtgactcagaatcttggtgctttttatatactcaatgttaaaatagtaaaaaagttctctggtatcccattagagtgtcaatattaaaagttagaaaatggcaaaagttagtaactttgcaatgctatattcaaacttataatttttcatgatctaatttgcgcaatgctgtgtaatgtagttggttattggtttgtgcaaaggaaacaactttcttgtcaggttttgggaagagcaaaggtccttgtggggggttacaagcagggtttcaatggactgattctatatgataatgaaacaagacaataattttcccctcatgctagatttggttcttactctctctctctctctctctctcttgacaggtaaagttgcatgatccaagttgcaaagtagaagaatttctacgcaagacattagatcctccagattttgagtccatacgcaatgcaattatagttcttcaagatattggggcattttcaaatgatgaaaaactcacccaactaggggagaagcttggttcacttcctgttcacccattaatatgcaggatgcttttttttgctatattgatgaactgccttgatccagctttaactcttgcatgtgcatctgattatagagatccatttacacttccaatgttacctgaagaaaagaagagagcttcagctgccaaatatgagcttgcttctttatatgggggttgtagtgatcagtttgccgtattggctgcatttgaatgctggaataatgcaaagcaaatgggtctagaagcacggttttgttctcagtattttgtgtcttcaagcaccatgaatatgttatcaggcatgcgcaggcaactccaagcagaactaattcgacttgggtttattcatgaagatgtttcaggttacagtgtgaatacacatgaccctggtgtgctccatgcagttttggtagcaggtttgtatccaagggttgggagatttcttacaaataaaagtggaaatagggttattgttgaaacaacaagtggagataaagttcgcctgcacaatcattccataaattttaagttgtcattcaagaaaaatttagataacactttaattgtgtatgatgagattactcgcggtgatgggggtatgaacctaaggaactgcacagttgttggaccacttccacttttgctgctttcaacagagattgctgttgcccaagcagaagaaaatgatgagggggatgaggatgatgcaggaggtagtgaagatgaagctggaagtgaagatgggatggagtttgatgctgagtccagtggaggtcgtgaggataagttgatgtcttctcctgatagtatggttaaagtaatcatggaccgttggctttattttcgttcaacagcaattgatgttgctcagatttactgcttgagagagagattatcagcagcgattttatacaaagtaaataaccaaattttacttgtttagtttttcttgtacttctcacttttgtgatttatccatgtcattcatgttatgatattcttgagacattggtttacatttttaggtaacacatccaaggaatacacttcctcccatcatggcggcatctgtgcatgctatagcttgtattctgtcttgtgatgggtgcattggtgtgcccgcaatgttagaaggtgtggacacactaaccactatggtcaatgcaacaactttaggcaagccagcaacaggtactaggcgttttggtaagagaccaaaaggatcccttgcagagcttttaaatcacgatgggcgccagacctctgggccttattttaaagcataggaagttcatcaagtgggatcaaccccaaacctgatcctgctttctcacgataatggtccaaacggaaggttgatgattgtatgttcagttttgaaagaagcttatatagaatacaaatcctaacagtgaaagtgaaacttgcgttcagcttatatagagaacaaatcctgacagtgaaaaattcagtcagaagattgcctttttgttccttgtgcaaacaatgccttctttttcttggtcggcagatgcgtttgtgccacaactttcaggtgtgtgcgcagtgagatgagatgatggattctggacattagttccctcgcttgtacaaccacatagtaaaatctttgtaaattctagtgtgaacgtttaatatgaagagtagatgtagaatagttaatgaaatcttttatattataaaatcaaaagaggaatgaaatctgtgctgtggcctttgagttgatcatgatataatatttagagcgtcagcgataaacatgagatttatgagcatctttcttcatgtaacaagtcaagatttttattctggaaaaattgccctgctattcagcctgacagacctaaaatctaaatttatatactttccacattggaactttggaaatatgtcagtttttgaacaacggatcgtgttaatgtctccacaaaaaataagcaaatatgaaaatgatggtcaatcgcatccctggatatttgatccattgatcaccgctgttacgtctttcaattagcctcaaaacagaggttgatgtccccactgttgaggacatccaatgctttcctatgagcactctgcaccaagattataaatcaaacaaaaggttatatcagcaacaacacagaaagtgatatcagtacactgctaattattaccagaattattatttaaaaaaaatgatctgttatatgtggaatgcactgaactgagaattttaagacagaatagtcgtaagaattatttcagttaaaaacaaaactggagaaagtgatgagttaagatgtctataatgccaatggaacagaccaaaatagaataaaaagaacatcagagagacaggaagctgagatatcataccagcaccataacattgtcattttataaatgcccagatgctgaaacctaactatttaggcaattaccatataaattttcaggaaaaaagaaaccattaacccccctgcccgccaacccccaacataaaaatatatgacctaccaccattcacaacagaaaggtgatgaaatcatagcaaaacctaaagtgtgatgagtgatggcagtagttaagatataccttcaagcgatccctctgtccatgtattgtagagaggatcgcttccccaactgcattagcattttccagctcgagcgcagtgccacggatggacattgcttgtgcctcctcatcataaattctcaaaacatgacttgaatccccattctgcaacgtgcaaattagcaaagtcagatatgcagcgaagccaaagaaacagtgaataactaaaccagaatatgacagccagcaattacacacagctcgtcccagaagttccgctctttctttcgcttccatcatctgcttctgattcctcaagttatgtttatccaaactttctctcaacgattcatcctcttcagctatctgttccctttttctgctcaacataaagcaacacaagctgaatatcctagcgactaaaacaaatgaattgcacaaacagcaactgcatctgaatgttgctaccaaacattgacattacatatcatattcaataagtttaattgcacttttgatcttcctacttttttcaatttcgcaaatttcgtgtctccattttttttttttttacaaatctgatcctcactatttaattgtgcaattttggttcattccttagctaaacatcttatatttaacagcaacaccaaatgtcagtgtagcaaagtgtctggttagcattttttttgttaaaagtgccattaactctgtaaaatattatcaatccctctaattccaatgtctgaaaaccttagcacttcaattcacataacaaaacttacgaactagcaattctcctaaccagtgcatgtgaatagacgcgcattccctcggttcaattcgaagcaccacggcgtcgtaattattaacatgcaagatattttagaaacggaatttcgagtggtgaatttgataatgttgattattaaactcttccagagatcacgttgagatttggcagcgatggagccgcagaggtgatccatctgaacgcagagggattggatccgagtgatgtcgttgttgacggcgaacgacaggtcggaggaggactgctccgactgctccacgcgctcgaggccgtcgcgtatcttcagcaaaagcttcttcgcgctttggtaaatctccgataacgttcctccggctccttgcatggcggtaacagagaaacaaatcgaaacactcactcttaacctcaatttcgaacacgtaaaggttttcaaaaaaaaaaaaaaaacggggcaacccggaatgtaaccaggttcggatacgggtcaagttatcaaggaaaaagaacaggaggaatggaggattaaaattcggacttattttagataggataataaaatatgtttatagtcattctaaagttctctaaatttttaatattttttgactttaaagttctctaaatttagttttagattttttataaaaaaattattctattttaattttttaatttaaaaatatatcattttgatttttgaagtggttataattaatttttttaaaatgtattttgaaacctaaaaattaattatttataaattaaaaagaagtaaatatgaaaaaaaattatataaaaaatgaaactgaatttataaaattttagaaggataaaaacgtattttaagttggagatatagatactgaattaggtcaggattttctgcccaaactattctacccgtataaaaaagagatttttatagcatcgtgtaaaaaaaatgttaattaaaaaaatctataaattttttatttcttaactcattgaaacactttttaaagacaacaccacaaggttcataaagtataaagcaatatttcaatacaataattctaataatacaacaaataaagttgaaatttggaatatttaattattaatattattaactgttaattttttttataatgaatgataaattgtattatttaatagtataattttttaatttacaccatcatttaatcataaatattaatttatgaattataaatttattaacttttataataattacattaaaaattaaattaaaaataatttttgttggattgataacataaaaacttttacatgatacctgcctagctattaaaaaaattaaattttattttttaattattggtcaaggattagtaaaagtaaaaccaattaattgaaaaaaaaaaatagatgcatgcgcagtcgtatttaaaagaacataagacaaacaagcaacatagaacaaacaacaccaactcccccattggcatgcagtgttcttggagctgaagaaagttccagaacacaaatcaacgacgtgcttgatattggtgcaagatgttattgtcttgtttagggttttaaatagatataaacaaaaatagtttattgccatgaatatcaaaacacgagtcaacaagaagcttcgcataaaatgtaaccttcttaccccaaacaaaaatagaagacgccggatagtttgaaactattcataaggacctaatactccacctaatcattcttgaatctacatttttaattgaagattggattcaactttaccatattagttggtgtgaaaaatacttgataagagtgaagagtgcaattttgataatatcatttaggaactgtttttgtatgggtaaaaaaatcgtttttgaaaaacttatttgtagtagtgctaacattgggacaacgaaagccgtgaacaacagccatagcctttatgtttgttttaccactataaattaatacttatataaattaatacttaatgcatgaattaatattgtgattaattgtttttcttttcttgtgcatactttttttggtatgtttgttataaaagtagaaagaaaatgaaaggaagacgaaattcatctatgcaagtttggcagtttagtaatatattgaagaatttgtgatgatacaataggttattccccccttttgattattttgatggagagacaagttaaggaaagcatggtacgtaatccccacgccaagcagcatcacatatttccatttggggaataaaatgatgtaccttttgatttgagatgtgtttgtgtattataagtggatgcaaaaaacataaaaaggtacgtaagagaaaaataattataattaatatatgtggtatatatgacatatacgtcaatttttagatgctcaaataatataactcttctcgccttttcattgtttttaataaaatcaaacaaaggatgataaaaataaactcttataacatgaatttgtgtctacgaaaataaaacattttttttcgaatttctattaattaaatttaaataataatgtgtttttttttaatattctgtggcacgtgttttaaaaaattgatctatattaaatcaaatcaatgtttttttttcttcttttaattaactattcaatcaaataaaagttatttttatcattttattattggtacttaattttttttaaacaacattaagtagaataaaatatttataaaattttaataaaataatatcatattaattaaaatatattttaagttttttcaaaacttaaaattaaaagaatgtaaatagatgagtcgatacttgtaaaagttaaaaagaaatttaataaggtttaaatttgaaaaagaaatcttagcataaaagaaaattaatatgaatatcctagaattaatttgtgttgaaaaataaatacagtactgaattagatttataatatagggacgggttatttttaaatctcattttatcataactaacagtgtcttaattcagataataagatctatatatgcttaaatttcttattttacataattgatttttgtttttcaagtcatgttttgaaaactataataaagaaatgtgaaaggaacaattgctgtcggtgaatgccaatattttcggatcaataatgctatgcaaagaaacatattaaagagtttttacccaccaaaaaaggaaatgaacctaccaaaaaatattaacaaatatttaaaagatactaaaatttataaataaatattttttattaaaaattatgatagagttacattaaaaatgaccactagtatatgtagttgacacctttatagtttaattttaacacattgttattaatgtacatttttttataaattttaaattaattattataaaattaataatttttaattatatgataattcataattagattgttagtatattatatttaaattcatatttttttataaaaaattatttttaactttttcatcaatgctttgagaatatttagttagtacttcttctcttctattaaataggaactgtgtgaaacgaatcattggttgaatctaacaaatatcatctaacaaatatcatctttttaaaacacattccatcttttgtatactgtcaattttaaatggaatgaatgatcgattggaggacaatagcgattttttctttgaaaaatagacaaaaagaatttatgtgcaatatacgcttcagcttttaagaattcattatttaattcaatttcttgaaaagtcattggccttggacttttggaggttgctgcagcattcatattgaaatattgtatataggtgagaccagtcttattattcgcgttgaggttcactatagctatacatatatatcacatatgtaaccgtgtgaagcacagaaaaatgatcaaaaactctgagagaagcagtgtaagaaaatacaacaaatctgaacttccacgcctgcggtggacacctgaacttcatcaacactttgttgaagctattgaaagtctaggtggaaaaaaaagtaagtttaatttccttcatatgaacaaatatataagatatttataattctagctagggtttatagcaaattatatgtagagtatattaagcatatcccaaaatcagttaatgaaagcatatgttattggatacaaaagtccgtttgatcgaaggaggccagtaatgttgatgatttcgatcaaattctttcattttgatttcttctgatccaacctcagaattgtccttgactccttaactgctttgttgactgacaattttttgcatgtctgagtttcatttctagatttctttgagtttgcttttctaattcttatagcataccacagtatctgagaagagaaaaattaatttgtgtttgcaatataatttataatagcacatatatatgacatgtatacatgggcggattgttgaggccaacggatcaattgggtgttggtacacacgaatttgagagaaaaataatttctattactcacaagaatagaattacagagatttacaaaactcaaacacaaaaaactctcaaactcagaccactgacacaacactcactaggaattctcactacttggaggaattcactccttggtgtttctgtgtgtctaagtgatgatttacaagtgaggtttgcacctctatttatagggggaagaatggtgtgaacgttggagggtggtggtagccagctggtggacagcctgtgtgcagcttgaactggaggacagctaggaggacggctggaacttgctggaagtcatcaattctccccctccagccggatctgaagaaaacattccagctatgtctctgcacaactctagcttctctcgagtcaccaccttcgtcatcatatctgcaggattcttctttgtatggatctttactagtctcaacagttgtcgatccattacttcgcgtatccaatgatagcgaatatcaatatgttttgtacgggaatgatacattgagttcttgctcaaatctagagcactctgactatcacaatgtaccttgtactccttttgcttgattcccaattcttggaggtaacgttttaaccacaacatctcttttccagcttctgcggcagcaatatattctgcttcggttgtggataaagcaacacacttctgtagtcttgactgccatgagacagctcctcctgcaaaagtgtaaatgaatcctgaagtagatttcctactatcaggatctccagccatatctgaatttgtaaaaccttccaagattggatcagctcccccgtaacaaagacatatctttgttgtacccctaaggtacctgagaatccattttaccgccttccaatgctcttttccgggattggagagaaaacgactcaccgttcccactgcgtgagcaatatcgggcctcgtacacaccattgcatacattaaacttccaacagctgaagaatatggtactgacgacatctccccgatctcttccttggatgagggacataaactcttgctcaacttgaaatggttagctaatggacagctaacaggtttggcattgttcatattgaaccgttcaagtactcgttcaatatacttctcctgagatggccataacctctgattcttcctatctcgagtaatctgcattcccaagatttgttgagctggtcctaagtctttcatgtcaaaagacttagagagtttcttcttcagctgattgattttcgttgcatctttccccacgatcagaatatcgtctacatatagtagaagagcaacgaaattaccatcagaaaacttctgaatgtagacacactcatctgctgcagtcttcttgtacccttgactcaccatgcacgagtcaaacttcttgtaccactgcctaggtgcctgcttcagaccgtacaagcttttctttagcttgcatacgaggttttctcctgaaacctcaaaaccttctggctgctccatatagatttcttcttttaaatctccgtgaagaaaagctgtcttcacatccatctgttcaagctccaagttcatacttgcgactaatccaagtatgactctgattgaagtcatcttgactacgggtgaaaatatctcgtcaaagtcaatcccctttttctgttggaatcctttgactacaagtcgtgccttgtatttcaccatttttccgctgccatctttcttcagcttgaacacccatttatttttcagtgccttcttcccttttggaagttctacgatctcataagtttgattcttcacaagagaatccatctcatccttcattgctagcagccatttttctttatccttatgagatactgcttcatggaaactctctggttctccatcttcagtaagtaaaagataatcgaattctggataccttctggatggaatccgatctcgttcagatctacgaacttctggaatatgaggagattcaccatcatctgggtcttgtgatggtcctggaacatctggcagagcgggttgtggctccccctgctcaacaccatcttcttcctcattgttttctacttctggtatatcttctggcactgtatcaccatttcttatcaatggttctgttgctgcttctggcacctgagctgcaacatttgacttctgagatattgtgggcttttcaatatcttctattgtctggctttcatggaacgccacgtccctacttctgattacctttttctccttaggatcccataacctgtatccaaattcttcatctccatagcctatgaaaatacatggagtggtccttgcatctagcttctgcctgagctccttggatacgtgtgcgtacgctaaacatccaaatactcttaagtgagagtatgatggatcctttccaaaccaaagtttctccggaacttcaaaatctaatggtactgatggagatcggttaatcaagtaacaggcggctttgactgcttctccccagaatggctttggcagcttagccatactgagcatgctccgaacacgttccatgattgttcggttcatcctttcagctataccgttgtgttgaggggtacgagggaccgtcttctcatgtcgaatgccatatgatctgcaatagacattgaactgcttggaagagtattcacctccattgtcggatcgaagacacttcaatttctttcctgtttcacgttctaccatgacatgaaacaatttgaagtaatcgaatacctggtctttcgtccgcaagaaatacacccacacttttcgagaagcatcatcgatgaatgttagaaaatatcgattgccgccgagtgattcaacctctaagggaccgcaaacatcagagtgtaccagactgagtaactctgatcttctcgttgaagaggaattaaacgagactctatgttgcttaccaaacagacagtgattgcaaggatctagtgcagcatccttgtctacattgataagctccttctttattagggtagacaaccctttctcactcatgtgaccgagtctctgatgccataaattttgtgaagcctcattttctgcaacgttaaggctgtcactgcatatcttcacatgagtcttgtatagcgtgccacaaatatgtcctcgggcgactatcatagcgcctcttgacaacttccatgtgcctttactgaagtgactatcatagccctgtttatcaagagctattcctgacaataggttcagccgaagatctggcacatggcggacatccttcaaggtaattgtactcccagaacttgtctttactagaacatcaccaattcctacaatcccagaggaactggaatttcccatcttcacagctccaaagtcaccatcttggtatgttgtgaagtattccttgtggggagtcacgtggtaggatgctgcagtatctaccacccattctgtgtcttctcgtgagacgtgaaggcatgtctcattatgggtagaacaaaaggctacatctccaaggatagtaactaatgtttctccacccttgttcttcggctgcgaactgctctgggcttgctcttccttccacttgtagcagttcttcttcatatgcccttcaattccacaatgatggcacttgtatgttggttttctgccatcagtggatctgcccctgctcttgcttctgcctctccatttacttttactactcctttgttgcctcccccgattttctgtgacaagggcatgggtctaatctgtgcccatgtcatttctccttgcctcttcattgaataaagcatcctttaccatagacatggtaagtttgccatccggtgctgagttgctgagtgatactaccagcgtttcccaactatcgggaagagaactgagtaataatagcgcctgaacttcatcgctaagtggcatctctacagacgacaactggttgaccaagctctggaactcactggtatgctcggcaactgaaattccactttttaacttcatgttgactaaacgcctcatcaacagggctttattccgagcggtcttggcctggtacatgtcctccaatttcttccagagggcataagcgtctgtctcctgtgcaacatggtggaagacactattgtcaatccattgacggatctgaccaatagtttttcgatttgatttcttccactccaactccttagcagagtcaggatttttacccatcaattctatgggatcgaacaaatctttacagcttaggagatcttccatccgaggtctccatagtgtataatttgtagcagtaagcataatcatggctccggaagatgatgttgactcttctgtggtcattatcaccttatagtatcttaattcaccaaaacaaggttgaatcttacaaaatggagctcaccgttgcgtctggaacggtcaacaatgatggaattgacacttcacggccaatattcgactattgaggcaaaatagttgatgggtcacaagacactgttaaccacacaattagccaggtaagtgtatcgtgggagtctctccgtgctgtgcaacggtgactaattaaataaccacacactttcctagacaccaacggtgcaattagctttatcttgtgaaattgacacttcacggccaaaatttcactattgaggcaaaatagtaatttcccaaaactttagggaccaaatcacaatttcagaaagaccaggggtcaaaataaaatttcagaaagataaggggtcaaactgaaatttcagaaagataagaggtcaaactgaaattttagaaagataaggggtcaaaccgcaatttttagaaaaataactccggtcgtcttctcggcgatgaacagtaactccggtcgtcttctccggcgacgaactgtaacttccggcagagttgaccaaactttgactgcgatttctgggctcgtttgaactccgtttaactcgccgtttgttgcgttggactcgattcgacgagacgaatccaacggtgcaatcaaaattgaatttcgggtaaaactaagaaaacccggatcaacgaaaaacagaccaacacctctaaccaggctctgataccacttgttgaggccaacggatcaattgggtgttggtacacacgaatttgagagaaaaataatttctattactcacaagaatagaattacagagatttacaaaactcaaacacaaaaaactctcaaactcagaccactgacacaacactcactaggaattctcactacttggaggaattcactccttggtgtttctgtgtgtctaagtgatgatttaaaagtgaggtttgcacctctatttatagggggaagaatggtgtgaacgttggagggtggtggtagccagctggtggacagcctgtgtgcagcttgaactggaggacagctaggaggacggctggaacttgctggaagtcatcacggatctagcttatgagttgggggtagtgtccccccttaaatttttcaataaattttaatatatccttaatatttgtttgcaatgcttattaattatttttagtacttgttatatagtttacagtgcttgttaattatttttatttgtaattcatgcattaacacttgtttataagttgattaaagttcttactcttcattgaaatgagaagtacacagtttaaccatatgcattttgtagaaatattttagtctatattgtaacggttgtttaaagatctcaaattcaatacttatatctaagctaactctcatgttgtcatcatggtcttttgaaatctcataaattataataagcttatttcattattctattcaatccagaacagtaatttggtatgattatttgtttgtttctttagatttatgtttataattgtttgtttctttaattttttttcttaaaaaattttggggacgttatctgtgaacccccgccactaattatacagacataaataaatttttttagatctgtcactagtgtctcccttgattatttttctggatctgacactatcagaaaattattggttcataatatatatccatagatgaagcatgcgttcgtttcctctctttcttctctagcatttgtgtgtgtttgaaataacaaatcaaattaaggtgggaaggaaaggatctgtttgtggattgggatgcttaattaagctgcaaatatataaatccagcaaaatggttttgcagaggcaactccaaagcgaattttgcagcagatgcgtgtgaaaggacttagaatcgctcacatcaaaagccatcttcaggtatgcatgtaagcatatatatatatatatatatatatatatatatatatatatttatattactcgtgtggtccaaatcttattattattttttgtgaatgcaaaatatacgtatagtacctaatttagcaccaatttctttcatcacttaacagtactagtaaaatagttctaaaacgtgcagagattattatgtaattaaaatatgatttaaatactttttttttcttttcaatgtagtaatttttgttttttgttattgtaaaattatttttgtacttttaatctttataaattatatttatttattttagtctttaaaactgtttagatatataacattttgaagaataaaaaaaagtattatctaaaatgtcatgaagataaaaaaaataaaacaaatataatctgtaaaaataaaaaataataattttataaaaactgaaaataaaaaatactaaattataaagattagaatatatttaaatcttaaaaatatttctgatatgataataggatagtattgtcatagaaagtccgtatagatttattaattctccgtttttagtcctaaggtcacatctctcttccatctatattaaatgggacaataaataacatagacctagcttatacattggtaattagtaattattgcttaaaagcaaaacaacaaagcagatagagccttctttcaaaaagaccataattgatggagaacatgataataagtcactgcacagtgaactatatagtagtatataacaatacaaacatctatatacaataaactatctaggttagttacatatttttttatccataaaaattaaaaacagtaaaaaaattataataatttgtgatcttgtttaattaaccaagaatatttaggtacacatgctccacgaagagggaagatttaaagaaaaagaatgaattcctctcttctcattaattccagtatgtctcttgtaaattatagtaaaagaagatttttgtttcattgagtaacaatatcaaagcagccaatatgcagctctatacagctgtcaaattaattcaattctctctctcatcttgacaacaaaacgcatgcacaatgtgtgttccaatattcaggtcatacttaggttataataataataataataataataataataataataataataataataaagcagcctcactagctatctagagattatcagctcagagccattaggctggctactcatattttgtggtttttatatagtatcctgttaattattttagaagtgatcgagaaattagctagatcccgagtaaagtcagaaattaaagcagaaattcgttttaagaatatttttttttatacccaaatactgagattaaacacaagaccactgctggggaattataatgttatttacgtgtgtatatatatctgtgtatatatatatatatatatatacattatttatttcctttcttctattaattaatttttgaattagtatatataattcatgattgagttttcctacatccatccaagagaaattttgggttttgttagatgtacagaaacaggaaaggacatgccattattgcaccagtggatcagttgctggtaggaaaggcaaacgatttcaaaatatgttccatttctccaaccgaaaggtaaccaattactgatttttcaaaggatttttggttaagatgtctttgattagctatggataaaagaactaaaaaaaaatataagtatcccattacctagatgtttcacgctgtgcaaggaagaatattacatgcaacattatccttatatatgcaaaaagattatttctagattcgaattcatgatcaacaaatcatcaagatataactttaggttgtgtttgattaactatggatatagtcaaaatattttttttgtaggatttggacaatattttcttgttctgaactagcttttcaatttttttgtctaatatggtattcaagtctcatgttggatcactatctatttcgacaagcttcattaatgattatggatatggtctgagactactcaaattttatttatttctttttcttttgttatatatataccggttaagttataataactgttttaggcatgagagaagtatagttagatatctcacattaattaaaaaagtgattaatatacttctcataaaacttaagcaaataatgctccattgatggaattagcttttcaaaatgaattaggttatatatactatttttttataacttcagccattataaaaaaaagtcatttgaatatgttacattatgagtagtacattttactattatcactttatgaatcagttattttatcacatttttatttaccttttgcatactcttttaatatgctcatcaaatcgatagaaagctgggaacaacttttaatatttttttaatatatataaaagaactgttttatgactatgaaaatgtgtaaacaggattctgaagcgggaagaaactaattatgatctaaaccaggtactattttaaactaatattgatatcacttggcgtctccccaattttttttgcgacttttcattgatcatcttatgttgtaaaagcatgaaacgcaatgtttcaaattaaaacctatgttcttgtcttgatgacaatttagtaattgaattgatgcttctagtcgctgaaatatctctgcaaaaatatacacatactttaaactttttttttttatcggtattaaaagttgaatattaaacattcccgcacacataaacacttcctcacaagtctatttctttattaattagacttctattattaatggttttataattaaattacacatttttttagcatacgtactctcggaaagaagaaaatgtccatgtagtttatattccatgcgttgcacttacaaaatttcaaattaagaacttagcttactttaaattgttagatggggcaggtggaatggtgtttgcttggcacataaaattttagtcccaattaacttagaaaataaagactaactttaatttatatgtttttttcccaacaaaatgcttttttatatgtttatttcagacataagaaagtaaatattgaatacagcgttttaaatttaacatatcaaagcggaaaatacgctttgtatacaaatattgcatgatctaactaattacattctttattcttgattaaataaacgaatttgaatacagcgtattaaatttaacatttttattaaaaaaagaagaagagagaagaatataaatgttcattacatgttattcacagatatattttttgttcaaaatatatattctggaaccttgcaggaatcacagtcaagtggactcttgcttagtgatgatgtgtcaaatgaagaagaaaattttgctgatctatctttctcctttagcacgcctctgatgtccattattcaaagtgagaatagcaaagagataatgcgtttttcgtcatcaactgcagctgctaatcattccgttgattctatttctacgccgtcttttgcaaacaattacataaacttagacctaacaatctgaatatgtgtattaattctttttatttacttacacgtgcgtaacactagttttaattacatgttaactttttaggcaaggacttacaattaatagttagttaattattgtattctttattacagtgttaggcttgttaggcgtaataaaaggttctctttctttttctgtaacaataatgatacaagaatttaaaccatgcttattaattaatggaaattaaaatctaacggtgatgatcgatcaagttgagttggagcaactttctacttatgattgatcacttgcatatagtttaatgaaaatatcatattaattatgcatcttttcagattcaatcacattatgcatctttactgtaaacaactcagcaccatcatgatcatatgaatagccattcacacatgtcttattcttaaagaaaacagcataattcttttctaggagttatcacacgcagattgtggtcaatttcaatcctacctagataacacatttgaaattaatgatactttgaccaagtatcaattgtagcaactactttacctttttaccttatcaataaagcctccgtttgcaattttaattataatttcttttaactaattatccagatctctaaattaattatatgccttcatggaaggtcatgtgatgagtataatcaccatcaatcaaaactccgtgcttattattggctagctatagaacaaccaattccacaagcaaaggattttctttttgttgtgctatgggattagattagttgataaagtggaacgttgtattctcttgttcaataatttccaaatagaatcaagataaacttccatcgatcgatctagctataataacccacatacacatgataatgttattctcattttataaaatatcagaaattgtaaaagcttaaaatcattttgaacaaattataaatttgtgataagtacatttttccatggaaaagaaagttaattagttagcaagctggacgaagtccagtcgtctccacactctccagtactttatctggtttgtgattatacttaaacgacaaatgttattatctatatatgtatagtcatattcgacttgagcatatggtctctacaaaaaaagaggctacacatggtctttgtagcctcttttcaacccaaatctgatatccccaatgtcgatcttacatctttgtggagccatagcaaccaaaaactcggttaattatcagagtgatctttgatgatacctcccataccaatgaaaccatttgaaaggcaaagtgattatttttatgtctaacatttcaaaaatattctagcttgtatacatgatggacacgtgcaggaaaaaaaaaagggtataacgatcctttgaattgcatactgtttgaactttgtctccatttaatcaatgttaaattgtttaaccatacatttataacatgattcaacccatcacatttaactagtaatttcagtgtgtgaatggtacaagataataatcaaaattaatactaattaaatattttttaatatataaattatattttaaatttataataaattatttaaatttaaatttaaatataaaattatattacattattgacaatttctaaaaaattaattttggaatgaaaataaaagaaaatagattgaaaatgatagatagttaaaaaattaagtatgcaaataaaaataaaagaaaggacgtttaagataatggagagaaatttttgagtaattatagagataataagtgaaatacacttttttaattgtgtattttaatttataatataaaaataaactatgtaattcacaacgttataatgctagctatctaaaccactaaggcccgtatattgaaacttaaaaaataaatagtagttttaaaattctgtataaagtagtttatttttaaaatcttgatgtaacattttttaaaaaaaattataaaatatattttattgattataattttttgaaaagaaaaactttgacaaacatactaaaattttatataagtaatttcttttcaaattaaaagcaattttttcatgaaaaaaaaaactgacccatgcagatataaaataaaacttataaaagtatgtaattcataattgaaataattgtttaaatcaggtgtattaactccgaaagccattccttcaaatgaaatttcatttatcaagatacatttcataaaatcaggtgtaaacttcatttaaaaaaaaaaaacattttattgctccttagaaaaacaatcgaacgtcttcctgctcctaaatcctaattatgctagatattataattatccattcgtcccctatagactaaacttcactcaccttaaaaaagtaatcttttttgataaaatcgatggattaggattaaatttttttccttaagagggagaaagaggccacgtgtacttatttggatatttattatccatcattgcatggtacacttgctagttgctaccacatataatacttcatttccgcggcaaaccagaaattaaataccgtggtgtccatgatcttgttatatatcacatgaagattgacaaaaattcccgaatcctatgataatttctcctgctaaacaaatggaacgaaatactttaaaattaaactaataaatgtacattaataggaagaaaaaaaaggcagaatgaacatctttgtacaagttcggatccacagggaatccaaacactttcaattgtttctgttctgttacatctttcactacacatcattgacccgtatatcatttttctaaaataatatcactgagcagaattttcactgcctcttcgccaacgtcttccgcaaccctttgataatttttgaaaaccaaatcaagttcataactgatagcgccagcggcacaacaataactaacacttgtccaaacgcgtgcatctgctcaatctgttgaatgaataattgaacaaggacgtgagatcctaagctttataaagtagactttgcttgaccagaaattagaaagaaataaaccatttttaagattcccatgcaagactaaagtcttaaaacatttattacaaaatgaagacattacacattctccttcatgcacgtaaaatgcaacagtcgttattaacaactctcatacctcacaataaaccactccctatccctatcactatggacggatccagaaaaaaaattaagggggaacactagtggcgggggttcgggggcaactcccccgaaattattttttttaaggaacaaatcattataataaaagtgtgaaaaatggtaccattcaaaaaggaaaaaaatgataaaattagcgtgtgaccaatgcttaaaaataacaaaagtgtgaccactgcattcatgaaattacaaacatacaaaaccatacttactcctctcctatttttcatcttttttattattcttttttcatacttttcgattttcccagtataaacatctaaactattttttattttattattataaaaaattacccaaaaaataacctttttaaatgtagatcctcctctgcctaagtaaacactggacttattgagaatttaagggggggcactgccccctcaatccaatacatgcatccgcccctgcctatcacatccaggtgtatttttaacaattttctgggatgaatatttcatgactaactagttgacatgatagatctactatgacaacatttggctaagcaaacaaggagtcaaattgtaaatttattggaacaagttctaccaattcagtcttattatgtagaggtaatggtatgtaagtatatacaagcgtaaatggacagagactaccacactaaggatgagtttggttgtgtggaatggaagggaaggggagaattgagaagaaatatttaaattaaagtagtgtagaaaaggtgtgggacccacacaaaattttaaaaatttcttcacaatttgaacataaccaaaccaagggaattgctgatccatgcagccaaccaaacacacatacatgcaagttcaaaaagtgatcttgttggcaacaaatacatccaatagaagggcaacaaaacattattagccatcttaaaaggccaaaaattcaatgttaagatctgcttgctgcaaagcaccacataccagacaattcttaaattcagtcagtagttattacctggtcaaagtgcaggtagacatggtaacacatgtaaacaaacaaaagtattctggcaacctgcaggaagaccatttcagttagcatgtccaagatggcacagatgagattgctatatacttaatatgatatgcaattcacaatgattccacaaataacaccataaatgagtgacaatatatttcaaactgcaatgacttgacccaccagccaagcaatgaatatcacaaccccattgatgagataagcttttgacttcttcattccagctgcatcaagataccttgacaaacacagtatgtgcattagtaaataaattacatgacatatagagtgcatatttaggtgcaagattaccatctcaagttgatcccaggagttgttgtctcagagatcaggaccatgtatgtgtatagctgaccctccccgctcaacattgaaaacgctactgctactaaagaaagcaaatgatgaatcacctgaatcaatgttaatattaagtcatgttaaattcatatttacaaccaaatagggtgaaaaaggaaggaaaccaaactcttgccataatcaagtggaatatcttaaaattgaataagagagttcagatgatcaaggttagattggtttaaactatgcaagtcaaaagatatgatccttacatactcatatccaccaagagaaggaaaaaaccaaaatatcatcccaaggtcagcgatgaagtaaccgacagacacctgtcacattaaaaattaaaacataatacaaatttcatgaccagataaaaacaaaaatgtgttgcagctcataatatgatgatctataaacgtaagatatatactttttgttatcattggatgtatcagtaaaatcaagggaataacaagtccaaatttgttgtaaatcatgactagcaacatatagaagaactactaaaaggaaattagcagaagatatagatactaagaaaaatgagaagagtgatttagttaacatattatgccgatattatttgttaacatgctcagacaatatggctacacacacataaagaaatgatgataaattggtaacatttcagtctaacttattcaatctaggtccaaccaatgccaattgcattaatcacacactctggatcaacatatggttcacgctaataaaaaattgtcatttatgtactttaattatcaaatagattacattactctaggaagtatgcaggtctgaagagcaattgcagaacgctttaaagttaaaaaagtggacaatgtaaaacatatgggaatctatttatcttgcttttctttcttaagcaaatctttcagaagaaaaaacaaattatgaaaatcaagcagcaagttaaatgcagctgaaggcaaatagcatttcatcactagtatcctactgatcaagtcttgggtgtttgcattgatcattatacaaaaaaccttccaagtagtggcttcttctaagaaacattcgtaataccttaaatctccaagctggattccattcatggactacaaaagacaatgctctacttcatggaagttaacattacctacttgcttatcgtatatacttactcatcaacaattttcataaaatattttttttcttttacccaggcagcctatgatttcatctaggtctgtcttgctttcataacaaggcatgggtgttctccaaatttaacttccagtatatctagggattcagactcaacttacaatatctccatcataaaaatgtcaaaccatgaaaagcccaccaaaatctccaaaataaatcttatgtatattatctcatactttttggaactccactacatcatggcattcacgacaatatcagaaaatatatatggcaaaaagtcagtgatcaagatgatgctaataatatctaaccccacttggcagagtcatagattaaaataaaaatgaactccatgatccatcccttcattctattggttaggtgactagatttattgacatgtcctccgcagtgaagtgagacaattatttgtgattattcattattgtttatcataatggtgacctgcagagataaatcacaaagaggaagagaaaagggaaacaaattgtaaagagtccacatcattcttacccccagagcaaaggtagatgatgaagagcttcgaaatgtaataagttcggacgactggttgtcagaatatagatttgagcaaaacaccaagtacaacgacatagttgttatgaaaatagcatgaattgttgacatagaactgcacaaataataggggaaaaaatgtaaacatattatcttgttagaaacaaattaagaaacattccaccaaatgaaaacatcccctcaccgattattccactcaacacgttggattctagtgaggctggaatagctcttaaagtgaacagtgctaaaaagctgagtaagatcatagacctggaaaaacagtaaatatttagagataattgtaaaataaaaataataaatagcagtaatcttaaaagctcctaagtcaggtgaaatactttagaaaatagaatgaggataaaatttaatacaacataccatcttgcaagcaaaaataccaccaataatagaagtatatggaatcagagggtctgctaataaatattccttcacgaacaaattagcccggttctggtaggatttgaatttcatcatttctttagaagctaacattgcaacaccaccccttgaatgagaaatcctttgaagattttacaacctttctgcctttacacctgtctcctgttatatgaataaatacaagtttgaagacaagatattcaaaaactaaaagccaaagatgaatccttatttggtttctctatgaaaatgactcatgagttaaggataacaataattatcaaagaagttacattaattgagggaaagagacttaatatattaagtatatgtctattgtgtgccaaagagacaaggacatcagataattaataaaaactttcttatggagaagccagaatgctcatatataaggaaagaagaaatacaaggaatttggaggatagggtatcctccttgcagaaaaggatagtccacatccaaaattaaataaatctgctaatatctctcattcaaagcaatcttatgccaaatcatgtctaaaaaggtaagaacatccaacagaaaattcaaacattcagcattcaacaaagacaccaaaaattttgttcgcatacaagttgaattgccataacactcttcctctttactccatccaaaacctctgaaatcaatcaacaagacaagaaatgcttcatattctgtgcacatgcatacccaagtttcacccaaaggtcgattccaacttccaaatgttgctatccagcaatgttaataacaactaacaacactaccgcagatccaccaaccaaaccaacatatgctaaattcaattattaatacttacaggaaataaattatcaatccggagagggtaagagaaaaatgatataccaattcgctttagacctaaatatcagtaataaaaaatttatccattaatatcaagcctaaccagttaccactccagaaaatcaaataagttactactaagattaatgtgaagctgacaaaagacagtaaaaaataataaaaaaatgggggaaaatcttaaatcatttaagaaatgaagttcaccaaatgcaattcaaatagggctctaattttccacaccaaaccagcacccaaccaagttcatataatcgcaaccacttgacttgatcaagtgggattgaaatccttgcggatcttcaaagcaccaactatttgtacttctcccacacagagaactcattggcgtaagttcagggacagcaacaaacaaacaaacaaaaaatttacaccaaatttcagagagtaaaatctcttcacgaactaaaaaaaaaaaaaaaacgaatcgttaaagctttagcagcactcgagacaaaaaggaaggaagtgaagtaccgaggaagggcgaaaaggcgtgagtttggcgaagggaagaaatgcgatcggttgggtggtgagagcgtttgtaaggaaatttggagttgaaagtggtgaaggtggtgggatcatgctgcatgagttatgttgattgaagaaatgggaaggggaaatttgaacactgaaaaccctaacatgtttggattggattgggattgggattggaagaggtgaggctaaggaggaagatggcagataggaagaaatatggttggcaccccgcgtcgtttatacactttctcaattcttcttccttttttttttaaaataaataaaaaatgaaaaagaaaaatagttccactcccactcgtagctaactcagtattcaatcgctttcttcaatcatttcaattattacgtgtcaaatatggagtagatcttttttaaattaaattaaatctatctcatttattgtgttgggtactgggttccaatttcatgtttctagcttgtgtttaacggtgatgtataaaattaagtcacgtatcaggattttaattaacttaataaaataaaatgcatgaattatattataacttttttactagtctttattattcttacggataaaaaaatttataaatcgttattaatatgagttttagttcaccaaaatgatgatgatgataattactttatattagtgtataatttattttttcttctagtaatttttgataaataaaaatgtttttgaaattctgaaaattcgataattggctgattatttatttaatgaataaaatgttagatatttttatatttttgaggtgttaaatacatttattttttaatgaaatgttgggataattaacaagaagatactgtgtacaacattagtcttatttataatagggttggtttggagatattttcaatttaaaattaaaactaaaaatgacagattcggttttgttccgttccagaaaacggatgtccagtattgaaactgggtcttgatatgggatcaaggttctttctctttctttctctctgaatgctatgaaggttgaagcattcaaaggaaggtgaggatcacagcacaaaccgcaaattggacgtggggtgtgtacagtgtgaatggaaagagagtgtcagaatatttgtgtgtatcttgcacctttgttgtgaatggctatttatacttactaacctgtggataattgaggaagcttggccaatttctggttgtaatcttcagaaaatagacatattttttgtgaatatataatttgttaaatcttgcttgattctgtgtttatttaggactttaatcttttttttagcatttctgtaaataaacccctttattgggtctttacagcttttggcccaataccaaatatccgtaacagatttaaagatttttcaagtttagtatcaacttaaattaagaagtcagttctcaactttgcgagcttaggttgtttgattaattgaataaacagacaactactgatatgttttcaggtactgtaagaattatttatggacgaaactttcaatttaataaggctaactacttaattcaatttcatttaatgtactactaaaaaaattcattttgcacatttttttttggcatttataaaacgttgtttatattgcattgtatcattaactaacaaatgctaacatgccccaagtaaagcattggttgggtgaattcagagtaagttccagcaaaaagttaataactaataatttaagatattggaatttatttaaaatattaacaagagttaataattaatcttttaggatactagatttattaaaaattgaattgtttcaatagatttttttttattgcttgatagatgtcttttatacacacagacatgtagatcgaattcttaaacatatacttaggaacataattatatgtcaactatgtcatatgtaaataaaaaaatattgattattaaataaacaaaagcataaaacattttattgaatttttttatttttattaaaatataacattattttattattttacttgtagtgacatagcaagtaaaatttcaaatctattcctttataatacatttttcataaatataaaatccatttaaaatttgaagcatttatttacgtataaagataatgtaactattcagtaaccgttgttgaaagtgagatatgtgtgattgaaactaaaaaacgagagttatgctgcatcggttaacggggtgttgagtgtttgagtgcagaaaactcttggaagttgcggaaaatggggaaatctgttgttggaagaaaacgagggttgtgaggggacaagagttaatttcatgcttcctagggcacaaaacgtcttgctcaagcaagctatgtcctatatactatataatcgattaccttatcatgacaattaattgccttatcatgtgaaccagtgaataatgatgttcatggtaattaagcctacacgtcgtaaaaaaaaaacccgctcatgtcacgctttttattattatcattattatgtgtacacaaagttttcatgaatcaagttaatttcacgttgaaattgtgaagtcatcattctctatatatgtgatacaaatgaaagtttcaaatctgcacttagacttagtggaaaaaattggtgttataaacaacagtctgtgactgtgatactagcatccaagtcattagtgtacataaccatcatcaattaatcaaggttttctcctatttggaacttggggagcatatagtcttagatgttcctcttaatgatatatgaaggatgagcattagctaaaaataattttaaatcatttatttttttttatttttttttcttctatcacatcataaatcttataatatttatatatttttttttctttccatgtatcttatagcataataagtgtcaatgaaacatttttctaacaacaaatcaaacacagataacattcccattaataattaataactaataataataaagataaaactgacacaaggcacatatagtccatagaaataaaaagtctaaacctaaattaaaacaataacttatatgtcaagacagagagaacaaataaggtattgtttcaatttggtagcagcagctatatagtaaggtaaacttgaacatcatacttatataccagaagtgcttaattaaatgctaacacaatgcaatgaaatttgatttgatggaaatatactccagttattggtcccctccacatgctttagcatgcaacagagtatgcttgcaaacaacaacttcgaacactgaaaaagagatttcttgagatcagtcccacttcttgcaggcctctaatctggattccccacttagctctcttttcaaattgataagcacatggataacaaagacaaaatatgctttcacatgatcaagccccaaaattatgatttatttatggcatcagataaaatattgtgctatagcacaaaaagaaactgtattatatcaagctacactagtatagtacacgtgctttaacacatgtcatgtttgttgttatgaacatttgaaaaacactcatatatactaatccaacagcaaaagtggtggtggataattgaaaaattagaagcaacaacttataaccgtgaaaaaataatcgatgtagcatcaacacaaatatatccaacatacacttaatcgaaggctcactacatgaataataaaataggaagaatgctatgggaataagtttcatatataccaaaaacgatgtgtggctacaagcccgcacgctacaactattttattttatttgaaacagacatgctacaactaattgattaattgaatgtgtaaatattacttataaaagtaatgactagtatattacacacaaaaagtgtacaagtcctgcaaacaataaaataataaaataaatatatattaaattccaattacatatatttttaaacaagagtaaatattaatgaacttattttgcgtaatcattgtgttataaacataaatttttactaacaaaacctttgaattgataatttttattcaatatatgaagtttataaaaatcatgaaaatttaaaactgatcaacattttaaataattaattttacttttatgtataatattttgaaaataaatattaaatatgaaattatatttatataagtgtttcattttttaaaatttaatatatattttcatcaaaacaatgtcctgcaatttcactattaaatttacatttgtttgaaaaaactattatgtttaataaaattctgttttaaacacctatcacatacttcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaccaatattttacttagtttctttcaaagacggaatgcataaattaattttaaaagagaaaacttgatttattttataaatatttaagagagatgttcactttaggaattaggaggttaaatagtagttatattaaagggaaatgctaatcagtattactaagataatagttaaagaaaagaaagattttttattgacatacgtaaaattatattaatcataatttttttaaaacttttatatgattatttttattaataatatcttattcatgtagttatttgatgaatttcttatggaaataatattagaagtatacttagcaagtgaatctctgtgactttgattagtgaattttcaatgacgaaaaaatcagaaattctagaacattaccagcaatgatgagaatagaaggataagcatccaaatatcgaattggtgtatggtgtggtgtggctctttgaaggaagaaaatggcaaaattagagtcaccattgcctcatttcatcaaagactgcaccctacccttgctgctaacctcacccgcctcacttcctcaacgacctctcatacgaagccatctgccaaatcgcctccacgcagctccgcctcgccctcagcgtcctcctcgactccccgctcctccgtacaagccggggacgtgggaggaactggagaagcttctggaagggtacggagggtgtacggagtacgacgttggtcacgtgccaaagctcgtcgactcgtcgtcgatacaaccgccaatgtccccttggaagagatgtgttccgctgtgttggagtttatcttcgctcaccctgctaagccacctgcgatttagccacgtggctttttcctcgttcgttctgataatattaatatcttctttcttctaagatcgctggtagcatatgtaggataggattgtaaacattattaaaaaaactattgaaattctacttgttaaatatatatactccgttgtagtatttgtttatttaattaaaaaataataattttaatctctacaaagatatatctattatctaataatcacttggttcttataaatgaaaggattttgtaaattatttgataggaaagaagcaaaaagataaaaaaaaaaaaaaactttattttcccgtccttaaaaatataaatattcgtaataaagaaaataaacataaaagtaaaaccttttttcctcctttctctctcccaaccaaaatggacagattactataacagtgaatttcacattctttttattcatcctttttcccctcaataccaaacaaaagaacaattgaaattaatgtcttctttcatcatactcgtatttgtttcgctggttctcacttgtatcaaacaaataataataagattgaacctaatctttatgcatctattccaatttctaccattaacttaactgtttatttatatgtgatgaatttataagaactcatatatatactaagtattttaaaaccttaactattcattcaaggaataaagtattaagatttttaagttatcaaaatattaaatgttcttttatttgtttcaaatgataattaagaaggcttcaggatgatgcaccatttcttttttattcttcagaaaaatctataccaaccaccttagtggcatgaaatgtgacagcagcgacaggaaatttaatgaaaaataaataagtactttatgctttacataaatgctttacatatttggagaggtataaaaaaagaacaaaacaatatacataaaaatcgaaatttagaaattatctcaattttaagaaccaagattcgaattgagttcaagccttcaaggattctccaacatatgtgtgtatatatatgtttgacatatgtttagattttgtacgatcaataacgattaaatattgtaaaaaaaaaaatgtgaaaactgaaaccaacccctcctagaatttgatacacctaaattccaatcgaacaatgatgctatctgcacgtaattaaatgtgttcctttgtgttggagaatctgcaattttcaatattcctttttgaaattgttattagcaatttagcacgttcattttaggatgttctggaacgtagaactgcactgaaaatctgaaatccttatccaaaacaaacaaatttacgttggacccacttgccttcagaaagctgatgatacctacattactgtagtctgtagcagtaactaaagtttttactatccctttagcagagcgatttcctattttggccaatacaatatttcaatattctatcgcatctttttttccaaactttgtttctataattccacactctcataactcggaatatagcaccatttgccgaaaagagaaaaagataaatgcgattaatgtgcatcctaatcctttgcgttttgtataagttacaggtgcaatgcattaggaaattggtataaaaaaaaactatcacacaattttcatcttattaaaaacagcaccttgaacatgacaaaatttaaatgcagcttaataaataattagacaatggtgaacattcaaaatccaactcatttaaattttaatgtaaaatagaatatttaagtgttgttttcaattaaatttttattataaataaaattttcattaaacataattataaattattgagataaaacttcgatttgaaaaataaattaacacatacaaacataaattattaaaataaaactccaattttaataaaaaaaataacacaaaaatacacttgacatataaatttgtcgttttgaatatgaattaaatgaacaaacaaagatgtccgagagattaagtgattcacgaatgtaataactttttatgcttaaattccctaactactttttcctcctccaatcacatgttttgtatatgcattaataattgtgctgaaacatgaaaactagggacatggtcacaatatttattaaactttgggtcatgctaagaagacgagaaatttgagagagaataagaaaaagagaaaaagacagaacaatcaacgtgtagtttgcgttttatttctcttcaagaacacagggagtctcggttaccgagcatcatctctctctgtgttttccatatcttctctttccagtcgttggtcaacctttgttcattggttctctttctctttccatttcaagtcttcgcttctttggttcaaaggacttgagcattattgatgttaaactagccatcttcttcagtttcttcttcttcttcttcttcttcttcttcttcagcgttttcaagcctcttccaagagtctcttactcaagattcgcccctggttcattctctcaagctgctgctgagttcatcttccctcttaagtcttaactcaaagggtaacaccctgtatgtaatatttattcttcttttgctcttaacatctttctcatgtcagttaagttctaaaagttcaaacttttttgctctcatgcctcaatttatttgatggatgatccccagatgaaaaatcatctcagtttttgcttctgggaatctgagttttgttgcttgacttgcaagtgactttggtcttgtggttggcgaaacagtcacctttctcaattttgcttatttaatttgagcttagtttgtttggttatagattgtgttagctagcttttcaatttgagatgggtacttaaaggggtttaatttcttcttttgcctctaaatttagtcaaacagtgctttgactcaattggaatctcgtatatttggggtcatggataactcatatgattcatcatcatccttgagtttcgtatcatctcacctgtcacatggttctagtaatcacaacgtgtcttccaccaccagcaatgagcatggggcaaatattgaaattttgagtctgaataagctcagtggaagccttgagaagctattgattgaggctgactatggttatagtgatgctgagattcttgttgaggacatccctgtgggtatacatcgctgtatattggcgtcgcgtagtccgttttttcatgagctttttaagaaagggactgatggatcagggaaggaaggaaagccaaggtatctcatgtcagatttggtgccttatggcacagttggatatgaagctttccaagtgttcttgtactatctgtatactggaaggctaaaggcttcaccaacagaagagacaacatgtgttgatgaaacatgtatccatgtagcatgccgccctgctatcaattatgcattagagctgatgtatgcttctgccacttttcagatgaaagagctggtattactttttcaggtattttggttgtcatttttagttcttcttcctttatcttattactaatttttgcgtgaaaaagaagaaatgtgaaaaagtcagagcaattctgcaaaatcnnnnnnnnnnnnnnnnnnnntttttttttttttttttttttttatcggcaaatatattagttgttagaatgcaagttttattagtagaggggatcgacctgtgacctttcctccacttcccttctcccttaaccattcaacccaccttatatctccgtcctacccattaaagtatcccaatgtttacctaagactaaaagcagataaacattttacatttggcaagttttggaaattgtttccaacttacatgtgtgtctttctgaagtgttcaacactttatgtgcctagtgaacaaattttggaatagatgtatacctagcctaacttcacacacatacacttgtcactacattatgtacctttgtccactaagctcttctgattttccactgctgcttttaacttctaacatatatcttgaggatgatattttgatcctatattacttctatgtttctctattattaccaaaaaaaaaaaaaagacagacatcttttgcttaacaaatctaatgtaaatatctctttactgatgcagcggcatctcctaaattttattgagaaagctgttgtggaagatgtcatttctattcttatggctgctttcaactaccaactagaccagcttctctctcagtgcattcagagagtagcaaggtctgactttgacaacatatctttggaaaaagagctccctcatgaagttgtgactgaaatcaaatcactccgactcccatttcagccagaatccacacctaatgcaatggaagtggagtccttgaatgaaaagaatatcaggagaatccacaaggcattggactctgatgatgttgagctactgaagcttcttctaaatgagtctagtgtcactctagatgatgcatatgccctgcactatgcttgtgcctatagcgattctaaggttattcaagaagttcttagtctaggcatggctgatattcttcgtagaaattcccgaggatacacagttcttcatgtggctgcaaggcgaaaggatccatccattttggtagcactactgaataaaggggcacgtgcatcagataccactccagatggacaaaccgctcttgcaatttgtcagaggttgacaagatgcaaggattatcatgagaaaacagtgcagtgtaaggaatctaacaaggacaggctctgtgttgatgtcctggagagggagatgagaagaaattctatgattgtgaatatgtctgtttcatcacagttaacagctgatgatttgcacatgagactggattaccttgaagatagaggtagggctttctcttgtctaggtcactttgtttctatgaatattgggttttggaccttttagttgagttggaaatttgaaagggtaaaatccagaaaattattttccattgttcagaaaaatacatagattgatacaaatatataaactctaatgagactattccaaatcgggaataaatctgtgcacaatcaaatcctcctaattacagtagtaatggtaactttttaattacaaatgcatagttaataccagtaagctgttattttactttaggaatatgcatgcatcataaccacaacaaaactatatttgcatgatgcttttaaatttggaagcctatggacatgaaattaacatgctccatatgttgcagttgcatttgctcggctgttgtttcctgctgaggctagggtagccattgagaatgctgaagcagattcatcatcgctgtacgcatattcatcggctttgaagggcaaaaatggcaacccgaaagaagtagatctaaatgaatctccctctgctcgaaccaaaaaactccagttaagattgcatgcccttatgaaaacaggtatgtccaagacaattttgaaatagcatccttatagaggttatgcatctgtggaatgtggatatgatttattctattaacaccaagtctagcttgcttgtatgttgccttggttggaacatgccacaattgtgaaaatctcagaattacatgatgcaagccaacaaaaaagtaaaaataaaactttccacttacacagatggagtgtagtaactactaattaacaaagaaactttttatcacttgtagtacttcttattttattttatataagcaaagtttatttaaaaacacagtacaagggatactctaactcatgtacaagagtgttataagaccaaatcagagggataagagacaagttataggatcagtacaccaatcagaaaaggagcattgaacactacttattttttccttaaagcatgtctacgatccaaccttaatcaattttagatttctagtgtgctagtgaagttaaaaggaaaccctgaaacaaaatattgtttctcataatctaagtagaccatatcatagcgtaccaaataagatatcaaatggaacttaaaactaaccatgcatttgtagtactttacagcttaacacaaatggaaatgaatttaatgcaacttgcaattgtagaggaaaagaatgatggtggtttaatgttgttattaaaactctgagaatgctttttgaattatgtacagttgagaatggtaggcgcttctttccccattgctctgaagttcttgataagtttctggaagatgacgaaatgccagatgttttcttcctagagaagggaagtgaagacgagcagagaatcaagaaagcacgcttcatggagcttaaagatgatgtgcagaaggcatttcacaaggatatggctgaaaataaccattctagtttttcatctgcggtgtcttcctcatcttcctcaactcgtagggaaggtcttaaccatagagtaaggagaaaatgaagtccatgttcttctatgtagagtgttgcaacttgcaagtagaagctgtggaatatttagaaaaaataagatggaatgttaaattagggggtttttctaatgaacatgggagatttttactagcttgatttagtttcttatagttgttgtaccaagagaagaagaaaaagaaaagaagacgaattggcttctagtaatatctttgttccttttcgaagacccaaaagtgttttacattgttatctgattatagattgttatataattgaaatttttacctcctctaataattactttaaagatcatatgcagactttttgaaagtcatttttaattgattatccttgctaaattgtatctatatccattgtacaccaaaataattgtatatattgaaaacataaaaaaactaaactcttgtttcagttgcaacaaggagtaacccttatcttcaacaaagtaatggaaggtttaatgtggacttattgctaggttgagttttgtttagaatattttttagaattgatatattaatataatataattgggcatctaaaaagactagtgggatgaatatcacctttactgttgaagtcattagttgtaatgaaatgataattgtgatgttacacgaaccaaccaacttagaaggtgaaattagattttctttttcttttcaacaataacacgtgagattatgttatcactatcagacatcaagccataaattatttatatattaaaggattgatggattccagcacaactcttggagagtctcaagattttttttttccttattttaatcctgagttagaggatctaaatttgaaagggtaagtcatttctccattttttctttcttttcttaatcttttgtttgttagaatacaagtttgaggtgaagtctcacattaggaatgaatgagaaggttgaacaccatatgattgagaatcaagaaacttgttggtagaaagccccaaaaaagggtgtcctcttaagcacgccacgcacattaactagataatagaattgccacttttaacattgattaattaatgagtaaattatattttcatttttttcatattgcactcggtactcctctctttctatacattacttttaacattttttattaatgtcgttaactaacatcaattgaaatatttaagcagacgaaattgtccgttaaagtaaattacacttgcatctcctatgttttttttcaaattgcacttgatacccttcttttttatacattacttttacctcttttgttagtgtgttgggaaccagaggcagcagtgatggtgaccgaagttacgacgaaggacaaggaggtggtggaggtgactatggtagtggcgacgatggctacagtaaaggttgtggctacggttacagtggtcgttctggaaagagtgggtgcgctcggacgccatgtaagtgggcgaggacgacaatgagaacaagagatgatattgtcatgggagagagaggaggaagagaaggaggtggtagtggtaagtgaagacgagttgttaaacaagaggaagatttgtaaaatccaaaatgtgattttgaagaagaatgcgatggtgttttagacataaatttttattaaaagtcatgtaactagtatgtgtctaatttctgttaaattatcaaaaggtatttaggacagagagtctatgtgtaatgtgagctaaacaattaagagattttttgtagggtataaaaaaggaagaatatcgaatgcaattaaaaaaaaaggagataagagtgtaatttactcttaattaatcaccaaataattcttgcaagtttgcaatgtttataaaattcattgaatgggactttttacatacaaataaaatataaataggatagaaaaatactgattcaataatagaagagtttttctaagtgagaaaaaaaaaaacatttgtttaaaacttatagtttagaaaagtcttaaaagtaaattgcagaagattgttttcgaggtaacttgtaaatatctaatggcaattaatttgatttaaagattgattaaaaagttaaagaaattcatatattgttttttgagtaattaattaaggatgattaaattttgatttgataagaaagctctaagtcatataccagaaaataaaaataaaaaatgtaactcaaaattaaactgttgtttcccattgaagaatgtcctgtgaaatttataatatacaaatggattaaacatttttccttctttttttacacattttaaaactgattatatgcttgcaaactgattaaatgaatgggttgctcttcaacacatgctggtaacttgagatgtatacagttctaactcaaaagtatcacacattgtataacagttacctcctaaccatattggtaaacttctgagggcctagaagtgaaaaaccataggcagtaggtagtgacaagagtttctttacttttcctacatatgccctttttgtgaagttattataatcattggcttcaatggaatctaatatttgcctatacaacaacaatgatgcccacacaggccacctgctagctgagttgagctctgcaacccctctctctgcctcatcaaaaaacatcctcgccctctttatttgtcccttcatgaatttccgccatttgtctgtaactcttccgcggaaaatgtcatcatctgaaaggccagcttgtgccaattcatcttgtgggagatatactcttcctcttctagcactataatgatcaagaactagaccaagttagacaaaacataatttgaatgatgtggacaattaaaattaagagtttaactttcatgtatgtaaattaaagatttttatattagaaaagtaattcttataaaataaacaatcttttcatatatgataatcgatataattaaattctaaaattgaatgttgaggggcattggcttaattgattgtatgaaacaagtgttatttttattcatttcttggaattgtgatgtgagatacccttaagtgacaagatgttcaatgccatttgtttattgtttttggtttaattgcaatgcattgaagtgttcaaagaaccttactcttctccaacatctctaagtatgttggtaagttgatttgcaatgcctagagccaatgcagcattataaatgctctctgttgaagcatttgattctggtgctatccccattactgggacactcataaggcctactgtcccagcaacatagtaacagtaaaggtagagctcatcaaagttattgtatctagactttctcaggtccatcctcatcccttcgatcatgtccttgaacggctgtttcaaaaagacaatgcaatgtcacttggatcagttttagcacataaaaaagaaggtgaaatctagttttataattttgtttttcgatagaattagtcctctattctgtataagataaccaatttacttctagtctctaatttgaacatgttatatctaaaggataaaacttacatagttgcataggtgcttttggcattattctttatcccaacttggagtttcactttgataatatgcataataaaggtttacataaatgtcaagtcaacatagattatcaaaggtgaaactcccattttgatagagaacaacatcaaaatcaactaaagaactttttatgtaaggtttgtcctaaaatgatgtaatgcttagatttgggcatgtaaagtacctgaatatcaacagggtactttgagacagtatgtgagagggcagcatcatacatatcatagggtcggccttcaaaaacatcactcaatcgttgctcccacctgtccaaggccccaggggtgatgtgtgaagcatttgggccatccactagctcatcagttcttctgcaccacactgcaatgcgcaatgaaaattgtcaattccaaaacaactctcactggagaagctgaagtagcagtgtgtaatataatctaatcacacataccataaattgcccaaattgcttttcggcgctctgcagtcatcaattgtgtgcctagagtatacagttttcaagatgagtcaattcaacaacaaaatatattattaacaaataaatttttaaaatccattaaaaatagtaaaaatattttaatctagctgctaagtacttttctgtacacagcaaaacaaaaggcatatatcatatgaattgaactttgtaattagacttaaggtttaggaacaaaagaaacatttcaattatattaacgttgtggtggaagaggagaaattactagatggtctgagaccatcattgtctcttgtctcccacaatcttcacatgacacataattgaattttatgaaatatttgtcataaattaaaaaacttcattatgtgacatcgtgcaaagattaactgagatcatgaacacataataactttgaaccatttaataattttctggacattatttagatatgatggggaacaaaataagaggactaaaattcatttgaatcagaaaaaatgaatgagaaaaggctcaaaacaaaagagcagcaagtacctaagtaaaatgtcttggcatactcagcacaaacttcaccacaccgatcataagccgcattcaacagatccacattgttgaaatcagcctcaacgtctttgtccaaatccagagctatgtttgtaccccttttgtgttcttttaccaaagctgcttgcttcagcaccacttcatagaccctctcctctgaggatcttgaagtctcagtagctgccactgcacttgaaaaagcagaagcaccactagcaaaactgattccagaaaacctcttttgtgttctttcaccaccactactactcctgcatgaaaaactcaccaaggagttgatgttctctttgggtccacaactcacccaaagaagaacaccagacatctcaagaacaaggcacaattttcactgctgttggtgcagctccacaagtgaaagtgcacaccaatgaaaagagagggaaagaaattggatgaaaaccttttgagaatgagtgtatacttgtggtagcaaaactatgatgaggtttgtttttgtttgtgaggctgtcacaaattttagaacctgcccaaagatatagaggaaattgtgaatgtaatcctatagccttaacacatgtcaaaatgtatggacagtggccttgtaatccttaacgtgatcaacttgtttgtctttagtgcacgatcctcttcactctcagcctctctattttgagcacaattttgttttgttttctttattttattgtagccccagaaaaaaggggcaaccttacattacattttacgtgtgtatgtggtcctatcttttgttttgcttgtgtagttgtagaatggatggcttaaatgcctttgatagtgtttttgtaagcattacttgtatagtttaggtttgtccagattcagagtcataaaacaaagggatcaacatcaattgattaaatagatgagttattataaattctcatatttatctttcttttttaccgataaaaaaatatatatttagaattgtaatttttttgttgagtctgcatctcacatctaaataatgtcttagtaggcagacttaattttatttgatatatattatttttcacgaaaggaaaaaaaaattgtattttacaataatacattaagtaattttactcgttgttttttaattaattggcacactcacttaagtatgagttagaaagtacaaaagggaatcaatgcatccaacactaagaagatttgatccacaaactagataccatgttagatctatatatatattattatgagggtaaagagacagcaacatatgcatgtaattaatgttatggttcattatcaattcctccgagaatggaaacctagctctttgttttttgacctacgattttttattttatattcaattaatttttttctactaaattgattaattttggaatgaagtgaaacctgacatgatagaagcaatgctacttgtagattatttaatcaatcttttacgtttatagtccaccccgttaactattttgactaaaggcactatccaagtcaaatgattaagaatatatcttattttacccaatccatgatataataacaggcttaacacttcatcacatgcatcacataacaattaagttaaactctgaaaccgtaatacgacagccgaagtaagacatacaattgaggattattgatttgaacttttataaaagttaattttaacttaaacataatctgaatatttgccacattaattgctgaaaataatgataaactaaaataaccaaaagctgtaaattcttttttgtcatgaaacacgagatgccataggaatattcgactttcgagcctcaagcttcttccttggggcctcagccacaacctcatgtaaaacaaattgaagcacaccaccacgtgcactttgtgtcaacttgatggagctgatctccaaataacttatgaacgttttccattctctatcgtggcagaaattgaaccaaagcttaaactgcctaacaggctttcaaatgtagaatatttaaaatattaattagagcataaagacgaatatgcttgatgttgttctttcctaccacaattaattaaccttgatgccaattcagatgcatcaaatattctacgacgaatacgacaagtttggaagttcacacggttggtttcttcttttaataacatcaactcttcaagtaaaaccaaacataaatgctgactatatatattatattgcaccttaattaaacattacattaaacatttcaatacaacccgcggaaactcgcaataaaaattaattttgcataaaacatttctttttctctatcacatgaataattaattattctgtaattacatctattaaaaaagttccacttcactttttgtgtgtcaaatatcacccaattagtcattttataatacatcttgaaatgttccttgttaaatataaataattaattcacgtaaggattgtagtcaaagtcaaatatgccaagacttgaaatgccctttatataacaatcaaagcaatgcaactgcatgctataataataaataatcaacagaatataagtttcagcatatataactcaaccatgctgccagttatagctaattgcagtagtagataagaaatcaaatcgcaagtgggcactttcaagtttttaacttattgtcctcaggagcgtctagattcttggagatggcttcatacgtttccttcaatttttttgagtgttaaataactctttctaagcatttatgagggatggaatttagcgtagtttaaaattttgaacgttggcgtcacattgacaacaaattaagttgttcctcttcctccatgtcaaagcttcaaagggatatggtttcatgaacttttagaatcccgaaaggactttgtctttttctctccatttttatggtgaatgtatgtggacaactagctagctgggtgatcaaggaaaggccacgataaccaatcagaaccaagttaatagtgagctgttaatattgtcaagcaataaacaataaggaacttggccagaattttctttttaaatgtttcatagagaacccaatgctagctattttacatccgaataaagaaagaaagaaatagctagaacagaaagatgtgatagtagtagtatgtaacaaaaagaaaacatgaaaaatgagaaatctcatgaagtacttgcatcgtttcgaggtgttcaaacaatagtaccctataggctgagaaaaccctaagtagacaccatgaatttcggcaaaggatcggacaagggcgaacgtattttgcttttttaaatcacaaaatggttataaaatttatatatgtaaacaaatacattattagataaaaattaattgttataaaatttattatataaacttatatgtgtattaaatatacattagaaattttaatattatatatagcgacattaattatttttaacataaatagctcagttggtttaaattgtccaatccgtataaaccttataaattacgaattcataatgctcttaaggattagaagcttttatcaaagggtaatatcggaattgtaatgtttagtgtggggtatattgaaaattcgtatgatgtaggaagcaatatgcctagtcctcttgggtcgtgaaatgtgggctgagttgctaatagcgattgtcatccgaataacccactcaacgaccccttattctacccgcagagagatgattgtaattggtagctttcaagtttcagagcttcggatcgagtatacacttttgggtaacgaaatgaaacgatgttgcgtaactgcagttgcacatgcatctattatagttaattagcttaaaagttttgtctacggtaattttatctgtctaaagtaattttatatattcatttattaattctcaactattttttaagtaaaattaactatatttacccatataattatgggatttactaatttacacacatatttttttaatatgaatatattgacaaactatatcattattgtattttaatatgtatatatactgcaatggcaagaattacaagtaaaaataaatactagcgtcacaccaacaccacttgatactatttgtatggataaaattcacactagaaattattttcccttgttacaaatcaacaagttgcatgattgatgaagaataaggaaaggcaatgacgattaattaaggaggtaatcccaagagaaaggcctaagaatttgaggagccctaacctccatgaaattcaaatgagccttgagaaggtgcatgtaaaccaaccaatcaccattcccattagcacaaggcattggcatgacatagccagaatctccaccccaaggaaaatggtacgatgcaaacacgggcttcccccacccaaagtcaacctttgactccggaaacctttgccctgaagaaacaacaaaacttggtcctttttcttttccatgcccacaataaatccttgacaaaccaggcacaggtcggtgttcttcaacccaatcaacaagccctaaaaaatggtcttctgtcacacccatcttcaaaaactcatgaactttctccgccacccaactcaatggcttttccacaagctcatcaaccgcattcccaccataaggaatcgaaagaacattgccaaaatacgaactcatgttcttttcatcattgcataacatcttccttccatcaaccacaatacccatcttggcaacaacgtttttcttaccatcaacactagcagttgcttcagcaaccatcttccacaagaatgcagagaaagactcgacctttgtgcgcttcacggtaccgtttgagctagctagtgcttgcatgcggttcaggtattcgcttgtgacgtagtatatgcggctgatgagtggctcagatttgaaaacgagtttcttattaggatctgacggtggaggtagcgccgagacgggaacgtacatgtggtggagtgaagggtggatggaaggtgggcgtcgtggggtaagaagggagcgtcggaaacatggctgggctgatattatgggcttgttgggccgggttgtttcggcccatgatacgaggaacatgttcgcagagtaggcatcagctgtgcgatggtcgaaagtacatgcaactactaaacccccacacttaagctgagttgcctgcaaaactcacatgtcttataagacaaataattaataatatgttttccgcgcgattaagaatcaagattttttttttaattttttttatttagagcatgtttagtgtatgagcaagcagcttcaaatttggtatttcttagatattataataaaagaagtaaacaaatcttagtcatggagatgcacattatttaaaaaaaaaaaaattttttttttttttgagatttcaaaatgagatttattattaaaataataaaagatattttgagaaatcttacattttacttgacaatatgaaatccacaaaaaatgatataaaatctcaatttgagatctactactaagagcatttttaatgcaagatcttgagcaatgattttgacctcaagatctaattttcactggatctctcaataaagaagttgaagagatcttcaacatggagaatgagttcttgtagaaaatctctcaatatctatacaatgtttaaaaaagaataaattttttccctctttctctctccctaagatctcaaaatgagatctactattaaaaaaaaaattagagagatcttaaaagatcatcaattctatgtggtactataagtttaccaaaaaatgatttaagatctctatttaagatctaccactaaagatgctctagatgttataatacttcatttctttaatcctatatataaaattcaattatctaattcattaaattaaaaaataataatttaattaatattaataattttattttaaatttttaatattttataaaattatcattatcatttatatttcatttttttaattatttttaatatattctttttcttcttttaatgatgaacaaacagttttaaatttaggtcttataaagtataaaaataagtttgactaaccagtactcttataatacttactaaaaaattcaaagaaaaaagattttaatgtaaaattataagaaaatatagaaaaaattaattatgactaacataatttttcacatctcaataaaaaactttattcttttagttttctaacctatgttctaatatactagttaacatatgctggttaacattttcaaaatataggtttgtttatgaagttgttttatagggtatcacctgaacagcaagcacgccatgtttcttccttggtacaagcttcccttcaacagtgtcatcaggattgtacaagttgaggcactgtagttcaacatcagctacagcttcaaaaaaatctaccccacggttactgcaaaacagctcaggctcacccatggtgttggccaccatttcaccagcaaaagggtaatagtatactagagcccgagccagtgcatttttcagtgacctcaccatggtttcaaagcaataatatttttcaggcaaaggttttttgtagcagaagaatacactcacgtctactgggggaatgagtagatcaaggtttgatagtggcagccattgctctttcattgaaagctctggtaccactacctcctccttggtcacactcacaatgaattctccttctccaaccttaccatccatttttcagaaatattaaagctgtgtagctagctaggcttgttaattcaccatggcagtactacttgattggcttattaatgcacaggctgtaagggtcgcatgaatttattggcagtggcctagagagacatgcgaattgaatgtgcaatgtttgatattaatgtcaattttaagcctgatctcatataacacaatttgtatcattaattcaaatcacgtttaattgactgaaaaatactatttccaattgtagtatcttgtacttcccgaacaatatcaaaacgtttgttgtgtgtaaatattactgtatttctgataagaataacattaaatgtcaagtggcaaattaattatggtagttgttggtgaccacccgcatgcttacttagttttcaattgagtatgtggttctatatatatccacttaaggtctttcatgatggcagaattggggacctgtgtgatgctatatatcacattaattaattttcactccatagtatcggctattaattaagtgtggcatatattacttcttttatttctggcaggaaaaagtcactggactaataaaaaaagcaatataaaaccgtctaaatctaaagaacattgattggtagtagtatattaccaaaatataaaaatcataaattaaagactaacacctatttgaaattttttaaccgcgacaagttgtcaaaattttttaacccaaatattaaggtaattcgtctttacttcaagaataaaattgatgctcataaacttgtaaatagtttttaacttgtatacatgtcatttatttatttttatttaaatttaagttttttatttactttattttttctaatttacaaaataaataataatctttaacattaataacaaaaatataaaaatattaaataaaataataaattaaaactaatttagagttaattcaaaattaattgatgttttaaaaaaatggcacgagttagaaaacgttttacgacttcaattaagtaattaaaaaatgtaacgattttgaagttataaaacattttatgactttatataataaataaataaataactgaaatcatttaatttttacgatttaaaaaaattgataattttttacgactttataaccagaagttgtaaaaatcctattgcttaccccaatttgatattaattcaaaacttatcccatttgataaattcaaaaacgaattacccattttagtctttcgacctcaattgctcccagaacttatatttatttttaattaggttcaacaagaaccgacagatatctcgttaaatagcaagaaccaattataattaataataattcagtgacttatttaaaaatgacaaatagtttaaagaattaattaaaaaattaccaacctctctgtaggttaatattctcactagtgtaagtcagtatttttttctcttctggttctaaactcaatagttataagtacgtcaatcagtttataacctggatgagtgaaaatactatcatgcagaacctaatttttttaaaaaaataatgctttcaaacaagtaatgtgttgtgctcctgcaggcatgaaatcggttttattgaaaatattgttaagaaggtatatgaaaatatagatattttaaacctttacatactggtctgaacactgttggactcgggcctcgcatagaagatatgaaatcacttctagacaagaagtctgatgatacaactgtacgcatgttgggcatttatggacttggtggagtcggaaaaacagaacttgccaaagctttgtacaacgatattgtgcaacagtttgatgctgcaagttttcttgccgatgttagagagaaatcaaaattttactcttggctttggattccagtctttcttgattcaccttgcatcatgaatgtttggaggagcttttttttttttttcccaaaaagcactaaagcagaaagcttaatctgagaacaaaaaaaaaaagaaaaaatgttactcaaaaccgctaaggttttgattgatgtagtgtactagaaaatttaaataacaatagcatcataatattaaaaacaaattaaattggtaacattcttaccttaaccggtccaagttttcaaaggttgagcaggaacaaaggatcatctaagtctggaggaaaacctctctctatagcctaaaccaatcttccagaagataagctatagcctctcttagtaattaacacaccatttagtgttgccctcatctttgcttgatagagtccattgagaattccttctttatttcctgatacaatgctagaaatgttttttaaagtttctctactgaaaaaagttttatatttttagtaaaaaaactctcgatagcaagattgttaaagtcgagagtctacgtaaacttgggggagcttcgtatactcgactcatagactagaatcatagaatcgtaagagtctatttcaaaaaaaaaattccttatataaaaatataaaacataaattgatacaatcatacaatgccatcagtgcttgccattagcagttagcatcatgctatggaaaaaagaatcaatattttttcaaaattgacatcatgctattgcaattcaatgtatacaatgtcatcagtgcttacaattccaaatattatttggaaaaacagtcgggaaaacattcagttagcagttagcatcctgctaaccttttagaggaagatttaaggacacctttctttaatcttttgcagataatcttgttcaaaacattcataagcattttgttagaaaacaaactccactttggctgagaccccaccatgttagctattattggaagacaaggctggaaagataaagctctatcacatgtgcacctattattcatctaaatggagaaatgggttggcaataacatgggctgttgtgtttcagaatgctgaaggtagttggacgtgagtcatttgagttgtaaagcaaagttgccaccaacgtttagctataattaataggaatggtaggtaacataggtagcctataaataagtatgtgtaaggtattgaaatatgtgtgaagtgaaattgaagcaatagaaaacagtgtgtgtagtgtattgttttgtgtgtgagagaagtgccgtagcacttatacaagagtgagagaagaaattgctttgtagttgtgtgatagtgcatagcactagagaagaaacaaacagtgagcaatttgtgaggaaatttattttaatataattaaagtgttgttatttgttcctctttggtgtttactcctcctaaaattccaacacatttaactcatggtacaattcctacataaaaggagaaaatcagtcattaaaaaaggaatcgctaaaaaatttcaattggaaaacctgattttaaccaaaaagaacttagtaagctatcacaagtaggaaacatcatcaacatcaatatcaacagcacttttaactcaagttaattggggtcaatggtagatgaacccaataataaataaaaaatgagacaaagaaagagaaagggagaggggaaaaaaaagtggaaataaaacaaaagagagaaaaataagctaacataaaagagaggtgaaaggaagaagggagaaaagaagaggaaaaagactaaaacaatggaacgactggaacatataactactattgagtttaacccttcaccaaacttataacttttctccactccgtcctaagacatatcgtccaccaatatatatttcactccattaagtattatttaactacatttccccaggtaagtttcggtcgacctctatctctctttgtatcgagctcttggtaacaaactattattcttacgggagcatccagtgatcgtctcataacgtgtccaaaccacctcaatctatgctccttcatcttttcacatatcggtaccactgatacctttcgtcaaatatccttatttcttatcttatccatcttcgtatatctacacatccaccttaacatcctcatttttgttacctctattttatgttcatgttgtctctgtgctgaccagcattccgctccatatagcattttcgatcttacagctgttctataaattttccttttagcttaaggagaattttgtggtcacacaaaaatccagatgcactccaccaatatgaaccaatataaatacacttgtcggtatgcctaaaaactgcatataggtaataccgaagatccatgaatcaaaatcatgcagcatatattcaagaaaccaaaatgatgacaacaacttagtcaccagtatgtcctcgtttccctgctgctgaggatcagaggttgaagcttctcctacaacacccacagccacagctgccttcacttcatcctttggtcgtatcgaccgtcgaatgatctcatggaggctttccattcctctccacataacatgttatattctgtgcttcaacaagcccatccatcattgcatcatagtatatttccctcgttaattgttgcagctgaggattgtagccttttttctcatcacttccctgatggccagaggatgaagcttcttctaccacgtcgtcccggggttcttccttcactcctttcagtgcgagatcattatcaggctcaacttaaaacggcatttgatgttgcccattcgtctaaatcacgaaagctcagctttgcctcaaggagtccgttgataattccaatcgtgtacatcctcattgcaactgtgggtagtaccacattccaattgggtgacaatttaacccatttactcctgttttaagctgcacttctggttttaacaatatccagagaaggaaagctatgtccatctgtcaatccatcatatattattcccctcaatatttcttgatgctgagagtgaggatcatagccttgttcctcatcacttccctgatggcctgaggttgaagcttctacaactttcattgtactgattgcatctaggaaaggcgttgtgtcgagtacatgtaggaaagatgtcaggagggagtgtttttttattatcctgttcggattccaattcgtccttagcctgcgtagatatctcctttataaatccaattagggaatacaattcctctaaacctttaccctgcaaatcctttcttttttcatactagtccactcattcaatgaacatccgcttaatcatttcgtgtagagataattccactattatctttttccattcctgcttaggatctttcataggaactaatgccggtgacaacaacacgtttgaatgcttggggtcgggacacgtgatttggacatctttcatgttcttcgctccttcgaattcttcatacacaaagactccccaacaacttcgcgtcaaggtggacgtggcttcatatgaaacttgcactacaatccactcgtgctcgagaaacactgcatcaaggctaagccactcctcgtcactgaacaaaactcgtacgtagatcacaaattaagacgtgatctgctgcaactctgaagttgtaatagcctttgtggtgaggaacacatcgagtgccattgataacaaggtgcaactcaacaagttcaggaagagaatactgtctcgctctcgcccttccacttacatcctggaagaccacgaatccagaaacgaagatcctctcctccattgccaatgaagtcaaaccattctgagatctcggtttggggcatcaccacttctaatccacatattcctttcacggcttagcatacattatgtaagttaattcagaaaagaaaattaaaatagcacagatgatgtttacttgtttatgcatttctcatgttttacggatgtgtatggggtaattaactatttatctgtgtttaaatcagcttaccttgcatttgggtataaatcaaagaaaagtcaacaaaacatgcattttgtgtgtacatgtgcgagtgcatgttggcgggtgtgtgtgggtggtaaaactaagaaaaagtcaacaaggagtaccttatgaagcatgatataaaagtaaaatatatttatatatcattttatgatagttcattgtcacttttatttaattaaattttatagaatttctgattattgttagtatgactaacaagaaaaaagggtgttttaaacaaaaaattatttgaagagcaggagtaataaacatgtaaaattacactattctagtcccatttatgttttcctcaactaaatgaaggaaatatgcatctgaacacattctctttccaagcactttcttttttctcgtaaaattgcaaaagtataaaaaagaaatgtgcatatatcattttcctaagataaaggtatagtatttagatatgaagcaatgaatggtgatatatacatgaaaccatagcttctctgatgtctctctagttaagttaaagcaatatcttgcatctactttttgaatagtagatggcaaccatgaaatttcctcaagattcccacattgatgaacattgagaattctcaagtcagtgcactcaggaatattttgaagctcccagcagccactcgatcatatcgagacttgtcaagtgattacattccttaatgcatgcagggatagatacaaaattgttctccgatgcagttaagtcttctaattttttaaagcaattgagaattgcgagaagatcttcatctgacaaaccaccctttccaaaatacagtgtccttaatgttggacgaacattggctgctgatgggccatgtacgaacttttgaaggattctcgaagttgaggacatcctccaattttaaaggcatcaacatttggcaacatgaataagctacttggtagatacttaagtttcctgttatttgatatgtctatacaagcaagcccagtaagattaccaatggattcttgcagtttttgaataacagtatttatcaaaaaaatattcaatggcttgttcatttgttgcattatctctgggaagtgttcaagcttacacttaaggtcaaggacttccagagaaggtagaaatattctttgcaggaaatttctgagtttggtgcattctgaaacgcttaaatgagaaagtcgtttgagaaatccaacggttttatgaacagcaattaggtttctacaattatctagtctcagttcccttagattttgaactttagaaacatcatgcatttcggtgatagattggttatgtgaaaaattcatcttagtcagccatgaaaatctctgccagaaagaaaaggttagtacaatgattagcaacatgtttgggttatactattattttttaatgtgagtaacaatggaagcttttgttaaatgaaaaaataaaatgaagtagaaagaacaagaaaacattctacagaattgtaccttaaatggctcttccaacgttagatggcttctaggcaaattaaagacaatgatttccttcgggatgaaaaattttgatgggaaagactttgaaggatactcttcccgcagatgtttaggctcagatgaaaaagatgtgtttcgaacaatgagaattctgagccatttcattttctcaaaagcaaaaccactccaatctacttctgctcgctggtgaggatcaagcattatcccctcaatcttgtcacttcctttaaaaacaattacaaacaagtaacgtcaaatgcatgttgtcattattacaatagactataatgtataatttataaaacaaaagatacatgattcttaccaaatcgatcatcagttagtatttcaataacatcaacataatgccatagtccgctacgttggccaggattttttggtgcctccttcctaacaatctctctacccatatcttgtattagatcatgcatcttcaagcagccatactcaatggtgagaagagatttattaacataataccatagtctgctaagtcatttatggatttgtccttttggaccggttttaactgttatttgaccggtttaaggtgtccttgacagactcagttaatatttaccccggaacgtgtcatatgttttttgtctcgtagaggatcgttggctttacaagcgattaagggtaattaatatttaccccagaacaggtagtgaagagaaaagaaaggaaagaaattgtgggttctaatttttcactaaaaaaacataagaagtaaaaaaaaaaaaaacatataacttttattcagtagcaaaagaaaaatagagggtaaacaacaggaaagttaagagcatgaccacaaggaatatccaaattaaacaccagcaaacaactgaaaatgaaagaaagcaaaaattcaacacattctattaagtttaacactacccactttcttccttaatccctcactttcattggaatctgctaaaagtacatttattctggactaacatattcaaagatgatacactaatagctgtttccctgaaacttattcagcaactagattggaactttgtagagctggagaaccttgttccatgatggtctactgctaatgtcatcccaccaggcacccacatgcttcctctcctttaataaatactttttgtccatattgttcacaacataatcaagaaatggaaggtggctaatatcagcaatgctgaagaaatccccagccaaatacttagtctttgagagcctctcctcatagatgttcaacacttgcaccagctttgcttcactttcctcaatcaccttgggatctggagtcacaccaaatattgaaccaaacaaaccatgaagacacaagttgtgggcttgtgggtgaaagttgtgtgcttcaacttctagccattgctccacaagacccctctcttctattgtttttcccagcaactcaaccccttgagatctgtatttttctgcataatacctcattatagcacgagattctgcagaaaaacatgaaaacactcaaattagagggtaccagtaacaaaaactgaaggaacaatcatagatcaacaaaattggttaagctattaatcatttgatcttttttaattttagttcagaaaactgttgagttttagtccctacacatacatacaagttaagttttgattctattgctaacagcctaacacccatgattttaaatagtgttttgcaaccacaattgcgaccgcaatgtcaaacgtatagtttaaaatcgtaatttaaaatcatgctaacaccataaaagaatttctaacgctaaaacgtatagttttcttacaaagactctaaaacttaaagagatataaaaagcaagtgaatagtttaaccaacaaactatatataagtagaaaagcagaacaaaggagcacaaagtgtaaccatataaggtataatctccatctttgatgacaggaacaactccaaatggctgcagatattatgaataaagaacatgaatgagaagataaagaattgaagacaaatcatattcaacaaaaagagttgaacctgtagtttgaggtactcaggatccttctgctcccccttattgacatcaacagggacaacctcaaattcgacttccttctcaaccagacaaaccagcacccgctttgtggaagcacagtggggaccgtatactttcactaccatgttttgattctcttgaaaaatggttcaaatcaagagtgaaatggaagagccacttatatagttatattactcaggtttgatcagcacatatatattattgtttagttagtgacccaaaacaacttatagctctacatgtcaagtggtcagtgaaagcagcaagcaaattaacaaatatcaagttgatgggtgggatcaaatctggggacaccacgttaaacaagagattaatatttaatatttattgtataattttaatcaattaattaatgttatgcgtaaataactttaactttaactttagttaatagattaataaaaggtaaatggaatcaatattttaaaaatattggttaaaaaattaaaataaaaatatttttatcaaaaaaattgttatttataaatttttttacaatttaaataataaatattttttctttaactttaactaatatcttagaaatatttatcaataacatatttgtataaataaatgatatcagaaatgcagcataggagaatcacttttcattagttaatagttattaagtggagaaagaaactcactggttgcttctggagagactcttgggtccttatcttttttgggctattagattataagatcatacgtcgtgatcttatttcctcccttgggtcaataattcaggtgcacttattttttcaaaatatttggttgtttggtcataagtatatatgtgtgtgtgtgtgtgtgtgtgtttcgtttgggaagttttcctacgtgttcgtctttgctaacttacatatgtggtcttaaataagaatggaagtaactcatggtttccaccggttcacgctaaggagttaagttgatccttttgaaaaacagtacattggaacacgaatttgaattatgtaaaccccgtatgtacaaaaaggaaaaattatgtaaagaacctaaccaatggttattatcaagcctagttgcatatcttatttttcaaggttctcaattatattattttaatttttttatgttctaattgccctaattaagtcctcaactatttttaattctgcaatcaagtctctatcattaatctgctaaatataatatttttgctatattgcctaaacatatatattgatttgacattaacatgatgacgtaatgcttatgttacatgcaaaagtgagaaacaaatttagtaatggagatgagattcgaactatcacgccatcaaattgtgacaaccatcaagcactacattagtatgtctgtaacatgtcaatatgtgtgtcaacatctatcaatgtgacatcatgctaacttagcatatccatgtcatgttagcaaagtctgttaaacatgtaacgttgatggaggaatttgattgtaaaattgaagataatttagagactcaattaatataattaaaacctgagatattaaacttgcacaatcctagctaatatatctaacaaatcaaaaatataattaagtcttattttaaaagtaatagctaacaaaattgctattatagagcttttcagtggtttattattattattattattattattattattattattattattattattattattatttgctatattttttaaaattattatcttaagtatttatattttgttattaaacaagataacatgtttaaaataaacagcctcttctttttttaggtgaagacagctcataacatgttaacctcttgtacatagttcaactctaatggaaagccattgttataactacagtataagacgagactccaactaaaaaaactaatactacatttattaattaattaattgggagagtctcatgacttatgtatataatactacattaaactttttttttactcggcagagaatcaaagtgattaatgtctcacgtgtgtgagccatttggaaaaacattcgtcatatatattcttattgagtaagaaaaatagagggtaaacagatcgaatgcttagaacatgaccatgaggaatatccaaattccacacaaggacacaactgaaaataaaaaggagatcaaggaagtacaaatcaacacattccattccatgaggttgaacattacccactttcttcctcaattcctaattttctttggaatttggtaaaagttcatttattcttctctaacatatatattcaatgatgatactgttgccattccatataacaacagatactaataattcagtttccatgaagtccattcaaaattagattggagccttgtagagctggagaaccttatttcatgatggtctattgctaatgtcatcccaccatgcactcacatgcttctctcctttatcaaataccctttctcccttttgttcacaacatactcaacaaaaggaaggtggctaatgtcagcaacgctgaagaaatctccagccaaatacttagtatttgaaagcctctgatcatcataaatgttcaacacctgacccagctttgcttcactctcctcaatcaccttgggatctgaagtcactccaagcattgtagcaaacaatacatgaagagccaagttgtaggctggtgggtgaaagttgtgtgcttcaacttctaaccactgttccacaacctctcttctactgtcctccccatcaactctaccccttgagacctgtatttttctgcataaaattcattatagcacgagattctgcagaaacacatgaaagcactcaaattagcaggtaccatgtaagagtagaaccaaaattagttgaaccggagaaacaatattaatcatgaagcaagaaaatatgagttcaaagtgtaaccatataaggtgtaatctccatctttaatgacaggaacgcatccaaattaagggctgcagatattacgaataaagaacattataatcagaaaatacagaattaatcaaataataatcttgaagactctaatcatattcaacaagaacggaaggaaaatagatagatggaagagctgaacctgtaatttgaggaactcgggattcttctgtttcccccttaaagatatcaacagggataacctcaaattcgttttccttctcttccagacaaactagcacccgtttgtggaagcacagctgggtccgtacaccttcactaccatggttaatttgtttctcttgaaaaatccttcaacaagagtgaattggaagagccacttattgttgcttagttacacttcttatagtgcctctacatgtgaaatagtcaaacaaagtctacatcaacacaaacaaaacagaggttgatgggtgagatccggggacaccacgtgagaaagagggggatcaatgtttaattgatagggcatgcatgcattcaaaatacgttttcctgagtgttagtctttctaactcacacgtggtcttaaataaaagtggtagtaatcgactattactgactaaattggcaggaaattgatcaaaatgcattcgaaacacttcatcattttgtttacaaacgcgctactacttaaacccttgaaaaggtagaacgtgcccagatgacaaaatagggaatgaagagaaattcagtttgataataacaatgtcttcatttcagcttttaattcttgttcttggatcttattttaggacattaattgaattgaaggtatcctctccaactcaagcactatatcttttagttatataaatttacatgtcaagtgataattcatattatttgagtcactattgtttagtatgctgaattaactcattcactggaaacatattatatatataatacaatacaatataatataaagaacttcaaccaagcctttgatttaaaaaaaatcagatgggtctcttgaatcaatttttaacatatatatatatatatatatatatatataatataaatcaacatataaagtaaaaaatgattatatttttacaaaattttaaaaaaatgcaactcaaactgaaattaggtaaaagatctcttgcagcaccactatttccgaaagaaatcttgtaattgtaaatgcactaggaaagaataatgatcttctctttattaaaatgggaaacattatagaatgaaccctcaaaagactggccaattgttattttaagtttttcaacataattttttaaaaaatagacactttttcaccaaaaaaataatgtcacctttttatatccacgactaacaaatatcaatttattcacagaatgatcagcagctactcatgagaagaaatcatgaaagaaatctgactggacagatctaagcttcctaccgttcttatccaaaaccattcagttctatcactttcctcctgtgaatgaaaattttcctcactgcttacgcagggatgaaactatatatagttctatggtactgcaaaatttgtataatcaactgctgatacaaagcaaccagcatgctgaacgatgtttattcgtacttagttaccagaatattgaattacttctcatataagtgactacaatgggatgggatgaacatatacagatatcaaaatgacaccacagacagcaaatgagtctccgactatagctgagataatgtagtatcactttcttcaatctcatcaaattccactggtttcccacaaacaagcttcctgtaaatcaaatatcaaattataaggacatttataaattcatatattaagaatcaacaagttagaaataaaacaacacaatacagctatttcaaaataaaaacagcaaattccccaacaaaataaaacaaataatttataaaaacagtggattagatgcaactagacatgccgaacaaatgggtattcctcaaccatttggaatgactttttatccttcaaatgtgttaaactcgactgaaatttctatggtcaacaaaaatcaaccattactaacatccagcacattatatatatggaaagcataacatgcaccaactgaaattgtcatttgcaccaaaaaaaaaaaaaactgaaattgtcatttttgtcatcgttaaccgaaattttacaagtttaaagattttttcttctttttgctcctttaatccttcttatcaggtaaaccgatgacaatcaattgttaactagagatacctttgagatataaaattctcctcacacagtgctttatccagcctctcttcaaatggggttgcatgccattttactttctggtcctagggacaatgagcactaatcagaagctgtagatagatttagagaccttataacaaataatgataatgattacaagccatacctccttgtacttagttgttgaattcgggatgccattgccataccaccacttgaatgacataggcgaatgctcctcgatggttgacacaggacttattctagcagacaaatttgaattgacctcatcgtcattttcatctgaaaatttcttggaccctttttctggggtaggagtttcattttgagctttctcaaccaaatcactcagctcacttgaatcttcttcaaggttaaaatctctctccttgagtattttgcaccagaagacattatcacctggttcattagttggatagacaaactgggaccgaacttgagccttaccggtacgtaactcttctaatgatgcagggtacacagttcctggtgtttgcatctcgtcaaataacttcaatggggtaggataaggagatggtttatgcgcactttggctatttggtgacttgttttccttaatatgccaatcatctgatgagcttccatatgttgccaagtcagtttcactttcaaaacgaacagacttgttctttctctgagtatatgtggctagcaaaggtgaaaccaaagctgcattcctttcagacctatctgccgcatgaagcttccctgaccaatttttttccatatagtcaacagagtcatcttcagtatcttgtgctttggagatacagctgcaaaagaaatgaaattaacatctgatcaggttctagtcctccatccaatataattatcaatggacaattctaagttccaaccaacaatcatacaattaagtaattatctaaaatccaaaatatgaaagaaaggatgcaggaaccatttgaagggcactttttttaaagcagaacgaattgtctgattctatattatagttaaaatgcagttgctataccaggagctctaactattgagaatgtatctaatgcttactataaaaattgagtaaaaatcgaagattcacctaccatgcaaattgactaaaatatcacttgttcaaattcattatcattcaatatcagcattaacaaaaaaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaaaaaaaacaaattctatgagtaacttgaaagtatttgaaatttgatatataccatggtgcaagtataatcctctaggcattggatacaaaacaggtataacatgaggacacagcagatcatagaaagagtgatagatgactgacttttcacaagccaaaattgaaaaaagctaactaatggtcctaattgtggtcattattcaattgtttccagtatgttttacagaaaaggttcatgaaatcactctattgctttccatgttttttctttatactacattcatgaaggttcgtaaattttacaatccaaaactgtccaagaacaactaagaaacctatactatgtcagtttgcatattccattttgcccagcttaacgccaattcacaagataaaaattgaaccttattttactcaatgccctaactagttcaaacaaaaaatacaaaaattaaaacaaccaaacacctgagaaaaaccattaaaaaaaccatttcggctgcagtaatagtgcaataccaatattaatagcactatgaaaatacctcatccttaagcccctggaagtccccctcaaacccaacaccatcaatcctcgcagaatcatctctctcttctaaaaaggttatatcacaaaattagcgggaaaaataaaaaagaaaatgtaaaagccaaaagaaagaaaacgaagaaacaaagaaaagtaccctcagataataaagaagacgagcgatttcgagataccacaacaccctgggtttccacacagcgaaaattctaattactattaaaatataaataaagtaattcgtgaaaacagcaaagacaaatgcgaaatgttacggtggatcgagtggaggaggtaatcaattgtgatgtgtttgtgcggcgattgtctctgatcctgaagcacgcgaagaagcagcccatcgctttggtgaaggatcggaagaagaaacgtatcatgaaccctaacacgctcctcagcatatcagggaattcagaaaccctaacttggaattcaattgagaatcgagagacagagagagagagagagagagaagtgtgtgtgcgcagtgaggtgccttcgtccctgaagagtcgaatttgaattttgaagcggctcccagcgagggaaattaaattagaattattaatagaatatatattcatgatatcttctaacatactaataagtcagatattaattcgatgcatgcatgtcgctgacagatggatttttttttcttctaacatactaagtcagaaaccttataaagggagtttaaattttttcttcttcttttataaacgtctaacttttaataaataatgatttttaaaaaattactatttttagtcataaaattaaaactaattattaaataatgataacattaattattatcctaacaacaacaaatatacaattagttttacataattttatattaattattactttaatcattacaataaaataacaaacacaattaattttacaaattttatactaataaatattaatcgttattataataataacttacaaaattaattttatactaattattttttatatatatatacacattaaatgttccaagagagacgggatcctcgagatcttgttgatccccctctaacacaagttcactattaaaatatattgttttttcatatataaatgtagtgaattatatattattaacttagtatcacttttggttcatcatgttttgtatttatttcattttaatatattaaattttgaaagttttactttggtactttaaatttttaaagtatctcattttgatcaattctttcgattttcattagaaatattaatattatgttaactttaaaatttttaaataatttaatatagtgacaactaaaaatcaccattatctttattttatttcaaaaatttaaaccacaacaaaagaaaataggtgaaagtattaaaattaagggtacaaaagatatatagaaaaaaaaaaaatcatcaactaacaccctatatgcctctttttcatccttcccaacctcaacccttcattatccaatctaaatgttaaaaaaaaaaattaaaactattttgatttgtttaagtcatgaatttcattatatccaattcaaaatgattcataaatatctctaatttttaggaaaaattatttattataaatttgttatctgaaaaaaatatttatgatgtgattacacaaacttataatttgacttataaaagtgagattttttttttttacataacaaaatatttattaaaatcgtgaaaaataccataagttatgatacccaataaaaataaggtttcacataacattaaatgaaaaaaagacctatttaaatattctatgcattaaattataaaataacaactttgaccactattccctgatccgtaagaagattacagtcaaaaatatcctccttcaattccatgctcattaatttgttgtagttcaagtattctggtttaacttgttactagatatatgtctttctacaatttagtccacgaaagtctaaagtcactccctttttaatttctaaatgtattttttgtgttaatttaatcctaaatttaatgaaatgacaaaaaagtcagtaatttaggactaataagggagtaacttagaacttttgaaaactaaattttacgaatattaaattagtatttttattctatcattgacatattgaattggtaatatttgtttaccattgatatataaatacataatttttattattttcctatagtgttaacaaaatcatataagaaacaatttagagttttgttaaataataataatttaaataaaccaatccatttgtcataaaagaattttatttggtcttccttattttatttttcatttaagaattttcaaattagtaaccttaatttcttcattcaaaatttcaaaattcgtgtctaaaactgaggaaaacatcatagatgaaacattttccacctgctctatccaatgccattgaagaatgaaagaatatttgagcatttagaagcctcatagaaatagttacgggaaacacatgcttcaacatgaagaaaggttgcaggcttagattagaggtcagctttgactgaagtatttaacttgccgggagaacatatcagtgccaccacagggtatgtaccaacaattccttccatatttttacttttactttttcttttgccctttggctgtggactttttaaaacatttccttggttgtaaaacgatttcttatttttattaatttgttgaatatactgtactttaatttaatgattttttgctgtcaaaaaaatatttaattcagattttaggattaatattttaatatatatttagtaatacacacacatatatatatatatgagttatgattttattttcataatctttatttgttaaaattattaaaaatataaattaatattaatagtgaaataatttaaataataataattttttaagttaaaatatatatttaattcttatttgttttagatccttgttatttattttgatatattatttgcattaaaatataatatataatttatttaaaaatatacaagttaattaaaattaaaaaaaaatgcaggatgagctaatctatgaattttctcaaacttgataaaatttccttaatcaaatatgaattgatcatctcaagaaaagactcaagttcaaatctaattaataatgaaaaatacatggttgaaaagagatatctcaataaaaataatcaataaaattaatgaatactattataccattattttgttggaaaaaaaatgataaaattcaataaagatgacaaggttgtgttttaattttaacatataaagaagataataattttgagacttttgttcaaacctaggagtaaaaacaacaagatattaatgcatggaagactgatattggagaacatgaaattaaaataaattagttattaaaagattaaaaaaatggtattattttagtttcctttatacaaagctaggaatgaggtttttcccatggatgaaatgtgtagaattatgaatgcagtccatgaagcaaagctgaggtttcctgattttgacaggtgataggcattgatgaaagacagatacttcattatactccacgtttccatatctacaacaaagccacctgaaaaatgccacattgccgcgattccgtccttgcattctttgtcgcagtttggtcgtcagttttcacacattggttgctttccgagacggttttacatagatcctgccgtggttcaaaaactttcataaccaccagagaaatcttcaacctctcatcgcaacaaaatcttcagaggaatcaaaggaatcttcaaaccttcctaccagttgctggaaccaccatttgtgtctacatttttccaaggtattttaacttattcctaatttttaaaactttgttggttcaattttccataatcttggtcatctgtgtctacattttctataccttagacctagagtgcttttggatgagaaatctgaagagtgtaattcatttttctagcgaatttcaattgctgtatagtaaaatactttgcttggatagtgtgttcagaaataatttaacagtctaatattttgtacggacgaccttcacagaaatttaatatcttaacattcgtggcattcagaaaattatagtgtttgttaaacttggagcaaataataggagtgatctaattggtattacaaattttgctctctgggttttctattttaaaaatatatctttctttcacctttagcactttgaacaaatttggtggaggatgtgtttcaacagcacagtgacacagtcctcgcctcaaagatcttgatttggaatctaggaaagcagaagaagttggtactttcccattagttttctgggattccatcaaagttcagttttggaattgtagataataatgtgtaaaaattcatcttttaacgtgaagtgtttgtttatcatttttttttgtgtgtgtctatggtggttgctttgactgaagtttgattagtttcaatttgttgtcaaagaaaaggtatctggatttttatcagttatcctgaaatagcttattggtgacttgttggtcatgagtttgaatccggaaatagcctatttgcatatgcaagggtaaggctgcatacaatatctcatcccttacctgcgcatagcgtgaagcctccggacaatggggtacatagttttttttagtttttttaatcctgaaatagaaaaatctttaccatgcagcatgatatgaagcagcggggtggttgagaaaaatggttggagttgttgcagctaaagatttgccagcagagccctcagggctaagaggaagagtttaggcttggtttgagaagtgcgattattctctgtattgttattaattaagttcaatcgggaactgtatccaaggtgagttagatcataatttagtttaatttgcaattttactggctcaggttttggttattccgtcattgtatgttacaatgtattcttttaaggttgcggagagtcctgttgattctgcattgatccctgatgcggcaccattaaaggcatatcagtattttgaaagtaaatagtataagtaaagcattagatacttgtttactgttttcatttaagtaaccaattcatatcatggtgaattcaattgttaataagaccaggtagtcagcacttaattgcagactcttgatagtttaataatgtgttgttgttttggtttctactttctactgagttattggttatattttagggaggaaaatcatctaggattgtcgattgcatcctggcaatgaaacactatagtgaatgaaaaatgaccggggcaaatggtgtgtagaaatttggcagaaatctcaaatccattgtctctgcaatgaggaaaaactcagccatttactaattccttattatggaattcatcgaacaatgataaatgccccactgctcttaatctgacattgagtctaataaaatggtaggaaaacttggtttatttgcttagcaaaaaaaaacgaaaacttggtttattttgacttttatacctgctttggacttgtctagttgaacagaaagagtaagtgatgaaatattttattttgttagttgcagtgcggttcccattctttgagtatgcttgtacatgcaattctatcagataagaagcagaagaagtttcaacggtatgggaatatgtagctctgtgtttcacagctgaatttcatcacaactttaataatcaagattcaagttacaccttatagattataacttataagtctgttacattacttgaaactctctgtctctattatgataaaaagcttttgaaaattgtagcattatcatgaaagttggtatgagcttgtttcctcgctgcttaaattaatgggtctaagaatttttttaattgatgtcatgtgccccttgcttatgatttgatctgcatcacaaaatgtcaaagatcagttctaccattctttcaaatcttggctctagtttttctttctttatttatgatgtcaagtcattgtctaattatgaaaaacaagacaacagaaaatagcttatatagtgttgattactaactaaattaagatcgttgatataatatagtttagcagatttaaaagtgataaagcttagcagagagatcggattcgaccacagagagaggtcatcctccagacttagacaatcctttattcctgttcaaaccagaccaatttatcctatagttggaaactcaggaccaggaggaccaaactttcggcagttggaccaattaagaatgttatcaatttgttttaaatattaggatgcaatcattattctagtacactttggctctatttataagtacaacactaaaaacttaagtgatgttagtgtaacatttttttctttgttctcagattaagcacgctttctgctcttctagcattcattcatgatgatgaaccaagaaagactggaatccaaagccaggagtaaactcttttggaagttcaagaaggaacacaaagctatgggcaacaaatttgtactacttgaaaatgaaaatgtttctccggtaaaaattgtgacacaaccagctcttggaaaaatcaatgtgatggaattgattgagaaattcaacactcaatctgatgagtttatatcaaagaaagcatcacgactttgatttgtactaatgacttgaactctgcttcaagtagcacaaagatatttgcctgcgtatgatatgatacattattacataaaatagacaacaattcttgccgtataaatttcttgattactatgtaacaccacaatttccttcctaacatgcataacataaaaagtacgagcataagccactaacttgaaccctagtggtaataaaggagtttagcgaataggttaaaaacttttagattgttattataccgaagaagataaaaaggagaacaaacagatctaatatgtgtactgaattctcacttaattaattcaaatgttgaagaattagataagagtggttcttaagtctcgtctcaatgaattgcagaaacttgaagatagattgttaatcagaaggctcgtgatttgggtttttgcttcttattgttgtcactagtccttatcatttatgagaatctaaaaatagacaaaacctgtttgctttatgataaagtcatgagttagagttaagccaaaattccaaaattccttctaggggaatagcagagaatataaaataaataaaaaatgtacggaccaacagcaatgcacgcacggattacttactagtttctgattataattatatttactattcttgtgcttaattagtttattccagaacttgaacaatcgtttgtatttgtggaaaataatttttttcttcattatcagtcttctacgctgaattagaaagatggatatatatatatatatatatatatatatatatatatatatatattttgtaagttttttacttttcggaaacaactgtcttcggttctttatatcaactacatatgtataaagacctaaacttaaaagtgacatcacccaggagtcactccagataaaagttttgagtgacctcatattgtcacgtatgaattattgaggatcaaagcaaacatataaaacgagaaggaacgtagaagaaaattcatgcttgtatttctaatttcttgttatcgtatgtataaaaagaagaatacttcaaattagaattaattggttcaggaaaaatatgcaaacaataccatcatcatatgcaaattgttgggctgtagatttaattttatgacaaaatgtcttttagaaaggtagaaatcaatatttggaaggtttaaatacatttgcatttttttttcattttcttccctacaatttttttattttattttaatctttgcaaaatatttatttttgtacttaaagcattttagataatatttttttcattaacactatctaaaatatttttaaagatgagaaacaaaataaacatattttacaaggactaaaaagaagaaaaaaaattatataaaaaaaatgttaaattataataacaaaaagtatatttaactctgtttgaaaagggttattacttttgaaaatatttagaactagacagtgattttggtggatcttattcttttttgttaaagttagctttcgaaaattctctaaaaaaattatgtctttgaaatctcttttgactttttcccttcttaattgcaaatatctgttccattccaatccatatatgtatgtaatagtcaaagttgtgcccactcttgtagactttactccgttgttgccctcaaagctaacatcgattcaaaattcttgtcattggcatttcaccttcctcgattaattaacatttgtcctttggaggcccctaaataaattgatatgtattatcaggtcaaaaacttgtaagctttaattttatttttaagacacacacacacacacatatatatatatatatatatgcacttcataatggaaatatttgacttgactccagcagccaaagttcaatttacacaatgaggtcacaaatattaatataaatacatgggaaggaggaaaataataatttacacgttataagaaggttcccaagttttcaagtgttgcacacagactaataatggatgtgaccaagttacataactctgatgatgatgatgacaagaaaaaagaagaagttgtgcttcctgggtttagattccatccaacagatgaagagcttgtggggttttatctgagacgaaaggtggagaagaagcctctgagaattgaactcatcaaacagattgacatctacaaatatgatccatgggatcttccaagtaagatcagcttcctctttaacatatggtatcagtcactgaaagtgaaacctattttttgtttctgctgcagcagataaatttcatgagtttggttatgattcttgatatatataattcaataattaaggactagagtgtttgatatatatataaattgaatgaaacaagctaggataattaattaagcttaactaaagaaaaaaaaagaaatatatatatatatatatatatatatatatatatatatattgtgttggagaagtgtatgtatagataaacttaactagcacatcttaattattaattatatggataacaaaagactaattaaatggctcaattgatacttgacattttgcgaagttttcatgtgaagatgtagaaactcgggcttcaataatatgttattggataaaatataaattgaaaatgaagacatagttggtgtatatacgcatgatatgtacatgtagctggttttcaattctaggctagctagttaggtgtgcaactagctagccaccccattttgattttatatatttattgtatggatgatttcatgatttctaatctcaagtaattttttgtatatatgctgataactaattaatgtatgaagaagtgagttcagtgggggaaaaggaatggtacttcttttgcaaaagagggagaaaatacaggaacagcataaggcctaatagagtgacaggttctggattttggaaagccacaggaattgacaagcctatatactgtgttaaagaaccccatgaatgcattggtctaaagaaatcattggtctactatcgtggaagtgctggtaaaggcaccaaaactgattggatgatgcacgagtttcgcctcccacccaatggaaaaactagcaataatccacaagctaatgatgttcaagaagctgtaagtcaattatatatgttactctttgtttcgttaatatctatgcatcgttagcctacaaaattttacatatataattaaccaatctgatcatcataactaataaatgacttttacaatactttataaaaatcaataatttaccatatataataataatttataattgaatgatacaatataaaaaatctttacataataagtgcatacactattttttataatctaataagacagtacgtttgaaatttcttttttatgttgcatgtatttaaaagaagtataaaatattaatatctaatgggaaataaaccatctagaaccgcatgtaaagaaaaatctgagataaaatagtcaaacgaccacaacagtttctgagattcggggttagaatcttgttcatactcagaagaccactaacaaacaattgtacttataaattatattctaatgtcataagcacgtttattagaccctaaaagggagaaatgcatatagataaagacacatgaaccaatttatttattaaataatcacatcaactcttttaggctgaaataatttagaaaagaaggacagacactttcaataataattgtgttgtactatagctgtatacgtaaccatgtcgaatattgtattaatatttttaattgtaatattgtattttttataattttttcaaacttgtctacttaccacaacaattagatgattttttgtattatattttattatgttcataatgatttgtatacatttttaaaacattaatttttttttctcgtgatttaaatcattactttatattaatttacatactatattatagctgcaacgttttctgtaattttcaaattttgttatgttatgtattttatgcatatcccgaattgtatctatacttcctagtagttaattagccttccttatgatttgtagacctaaacttaaaattaaggtagttactcacttaatattttgttactaaaaaatatttataaataatcttgggtctcaaacttctagcacacatggcatgtacaaatgcatgaaatacccagaaattttggctccactgcctatatatatgtcaggatacgggtgttgcactttcttgtacagcaaattaagtttatactatttgcctattagctaaaaaaattaaaatatatgttatgtatgcttggaatatcttgttttataattaatatattataatgaagttttagttaagctaaaatccctaaactttcatttatagaattaaataaatacaattaacatcttaaaattcataacatatatgtcggttcctatatatgttcagtctaatctaatttgtgtttgatgacacgtttcttaggtcattggctcgtcaagctcttttgaattgaccgaatgggattcaatagtaattaaataaaggagaaaacaatgaagttaatagtaaactatcatttaaccatataacttaaattaataaaaaatgtaattataaaaaaaattgtagaaaaattaatgatcgtgtaaaaacctttatttattttttgacagggtaaaaacctttattatgaactagtgaactacatatcaaattagttatttttagaagtactacatatcaaattagtaatttgcattgttggtttcccgttcaattatactaaagcattgatggacaaaacgaaaaaataaaaagtagtagtacctaactttgtgctattaatatacttaacgatggtttacgtaacaagaaatctcgcaactaattaaatattatatacacttcgacaattttgtgtggttctcatctcagcgttacataaattgcatttatttcattttgtggcatcacttaatgcgatcaaccatgtcaactctagcattctgtctcttctgtttgcaagtttttaagtgtcttaatttttttatgtctttttatttatggggttcgcaggaagtgtggacgctatgccgaatattcaaacgagtcccaacttacaagaagtacacaccaaatttgaaagactcggcagcaccaatcactgagccaaatcaccccacaaactcttcaagttccaaaacatgcagcttagaatctgacaactgcaagccatacttgactttcacaaactcatcatccccacaactcattcaacaaaatgaaaagaaaccagttattaatggacatgttgacgttgaacctaaccacttatttctaggtcaattaggcaatgtggctcaggctccaacatccttggcttactcaagtttttggaatcatcatcagaataataatgtggaatttgctaaagagaattgggatgatctcacatctgtggttcagtttgctattgatccatccagggtttctgatcattgtaaagaattcaatagattttaagagcattttgatgcttaaactactaataacagtaacatagttttaatattaatatctctcagtttgaccaaataggagtattttgttattttttctttggcccacttgataaaatatattattgtatcaacgggttatagttttgatagtatttgtcatgtatatggtaccctctattttttttatatcaatctcattaggggacaattcttgttcctttttatttgtgtgtctaaatataattaacaaagcattgattatttgatttaattaactttaccagtcgtgtataataacagctgacagtagacattaataaagtgatgttttaaatatttcaatcaagacataggagtttagcttaattatttgatttgaattattataaattttttatacctgtttttgttttgtatcgagaaaaaaaaaacttcaatcaaggaaacttagacattattttattaccggattatttatttaaattttttaattcacaagcagcaatcttattagacatatacaaaagaaaaaaaatgattaaattattaatcttaacattatgtatagttaaatgattgaataaaagaagtaaaaaaagcttaaaataatatatatatatatatatatatatatttaaaaacaaataaattccttataaatataatatcacattatataaaatattatctattaaatcaaaagatttcaaaaaacttatattttttaggataatatacgacatatttttttaaaataatgctgagactgggggactaagagaggggaagactccaaaagcccacaattcgcaaaccagagatcatagaattaaaaataaacagcttataccaaaaaacatgagggaccaaaccaacccatgacagagattaccaaaaattaaattcctcgatgaaacctataggaagttttacaagagttgtttctatagagatcatctaaaataaaagaaggggaaaaatcccaccaacaaaaaaaagaactatacacttcgaaggccgttaacttacctgcataagtgttgtcttctctaaaaatatgggagatgcgaaaattcatcttagaagtcacatataattatatatgcagtttctccatctatgaccaagttaagagacttgaaagcaagagtttccaaagtcgaatcacattctaaccaaaggaaattccaccctttatcatgcgcaagctcaatggctctcatggctgccagcaactcagaatgatgggaggaggacaccccatagaactcaacaaaaacaccaatgaacataccaatggagttcctaaaaacaacaccatcagccgcccttcctgggctgaatatacgacataaaattgggttgaaataacacaagataacacaaacttgtcctcaaaattcattgggtctaatttaacttttttggatacgttatgatagaacaaaacaaaatcttcattatatttcatttcactcaaattaaataaataaataacgatataaaaatgtaataaaattcactcactttcataatatttcttccacattttaccaattcaaacgatatccttatatttcattttcatctagacgcatacataacttcgacgtcaacacttataacaacgctccgataaattcgggttggaaatgggaagtgatgtgaaacacttagcaatcccatcaatgctgtctttttttttttttggtggaaacaaaatagctgttaatacaatagttatcccagtaaagggcataacttgaggaggaggtgaaaagagggagtgtcaggttgcaatgattctaaagaaagtcacgcactaaagtactacatcaagttattcgtaaaacatttgtgggctttttactagtcaattcttcaatatttatgatactccatcccatgggactcgaaaaagctcagttgtttaattgttgaaggtcctcaattcattgtggataaaaaaagggctttattcgttgattaaatgttacatatcacagatgatttaccggacagctcgtgttgtattacattatatttacatcagaaaaaaggtattcacttttcagggcaggtcataacacagctttgattaggcaatgataaaatgaaaacaatatggtttacacgctcatccaacaaaatggtataattacattgcctaaagttgaaatttgctctatgttgtatacttgtgaataacatatcagggttgatggaaagagttagctccttgttcatggtggtgattggttcctggctggctaaccacaggaatatccaagctgcttccatcagtttcaggagctacttcccttacatcagctatcctcgcctctgtagcctgaatatcactccattcattatctccaactggttgattgttcacctgatctgttgccatgtggactacattctctgcagggacggggatggctctagaaacactcaggcatgctttatccacattctcttctgtggggtcaacatgctttgtatctgagcatgactctgtcttctcaaaaacttgagttgtatcaatgtgttgcctgttgtaaagaaaaatagctgctgtcaactttggttttatgatgctccacatttcatactgatatatatattcaaactcaatgaactcataaaaaggcaaataaaccatcaaaagtctccttccatttccctgtttcactaggtattgatatatactatttccatctttatgtttatgtgggaaaacagaagtagccaacaaatctaatttaacaaaacaaaaagcaagggcagaagaaaataaggcattagacatttagacctttgaagttgggcttttagtacattcacatatgcaagaagctcttccttctcttttaacgctgtggattctctctgaacagcctcccttatcctagtttcagcatttgcttctgcaaccctaaccttttcttctgctcttactacagctgcttctaagatcacatcatgctctctagcttttgcaagttcagaacgccacatatttgcttcctgaatagcagcatctctctgcctgattaattgctctctttctttgcttaagcccacaatcttttcttcagactctttcagctaccaaaaaaacaatttaagacaagatgaacattcaagacaatttcattgcaagtaatacccatacatagtaatagctaagggtcaattgtcgaacgcagtttaacgagaatcacttgaatttccatcagccaaaaaatattttcaaatgaaccagcacaatggcataccttctgtgtaaacagctcttgctgcttctcagaatctttattcaaacgctcaatttctgcacaagcaattctccgatgctcatccatagtataagcagcagatgctgcagcctcagcagcttcagcagtctcagagagtttatctgctatatcttttatagttgaatcacgtgcccgaaggtctcgagacaaattctgtagctcctcatccttcactctaagtgtttcctgtagagtggagtagcatcttcagaaccaaaaggcccaagaagacaataaataccgacataaaaacattaaaaaacaaatccattctctatttatatccaccatcctcatttcctcttcaaaatcttggccactacgccccctccccctttaatagatactacaagaggaaaaagtgatattccccaatatactttcttccttttttttgctttcatttctttttctaagcaagtgaacataaatcaaaagtctgcaaacgttagttagccaagtaaacagtgatgaaaagggtagtcctcccctaaccccaaaatcaaaggagtaattcatgcattttcaaacaacaccatgacaaggaaagacaaatttctttgtttaatacatgacaatggcgtacaaagaagccttatcataattcaatttcaaccatattgtgtattttgccacaaccattattgaatgcattatatacaaagtacgacaattagttcaaagcatcacacaatcaaaattcataaaaagaaaattaaaatgttatagctagtaactatctagttaagggtgcatttggttaagctttgacaaaaatataaaaaaaacacacttttctgatatcactttctttttaccttctaacaatagtactaaaaaaaattcctcagagttttagcttattataaaaagtttaattaaactttttatcactgtacatgacacacatgtttaatctagtccttgcacaaaaagaaaaggtttccaaatcagtccttgtatataaaaaggctacccaaaaaaaatagtagctataactctgcagttctctgctgcaccatcacaaatgctgaactatacatttgagcacaagaaagacagaataaaccagagctagattgtaccttcatgattgttaaatcatccataggaccatcagtagtattatttttcatcattcccagagcatttcgcaaagaaatctgcattgccgcttcaatttcttttgaacattccaaggctgtcgaattggctgcagcaacaactgttgcaacagttcctaattttgtagacccattcccacttaaggaattcacagcttctttatgcgcttttagaaccaactgagttgcactaatgtcagatgataaaataaatcagacatcaaaataattacagctattagacaggaaatctgaaatagaaatgatccagcaatcattcaaattgattcactgtagcggaaagcaagaacatcagacaaataataattatagtaaataataacaaaagtaacataaatataaaggctgaattatgacatgacattagtattctgcaggtctccctttccaagcaaatgcctattcaaatgaatataaaaacacactgttcaaaagagttagaaaattgtgaaggactgcagttatgacttatgaatcctcaataatttgaaacatgacaaagtaaacaaagttttgtaagataatagaaaataaatgataaaactcaaaacaaatgcattagtacatttaggttcaagcatgcagtatttcatttgtaagctacacctctttatacacttttgaaatacaaagggattataacattcatactcatacattcgacaacataaaataaaataaaaaggataagattatattccttggaacttgccccagagggaaatgggagataaaagtgtgggattatattggaaaaaacccaagtcccacatcagtcagagatagtgtcaaaatataatatataagtgaggggaaaccctcatcccatgaactaacttttggggttgagttaagtccaaactcacattctaagatgtcctagatccattaaaaggtttatccaccatgttacctacacaccaagtccaaaagtgctaagcgtgagggggtgtagggaaaaacccaagtctcacattggtcaaagatagtgtcaaaatataacatataagtgaggggcaatcctcacaccatgagctaactttttgggttgaattaggttcaaacctatattctaagattataaaacttactgtaaagttgacacccatgctctagctacaccaggagtctccgcacagaggaagtaatcctttttctgtggtgtcccaatatctaaagaagccaattaaggtaacaagcagagtgacttccatcaatttgctgcaacatgatgattcataagtagtaaatgcgataaaaaggatacaaaagcagcacccatcgtactttggaagcccgctgtaatacacagaagtaaataaacaaccatgtcaatataagaaaattcatgcaacaaaacttcataaaaacatctggaaactagacaaaataggcttatgttaaaaacaccattcttactggaaattcacaggagatatggtgatggtgctattggcatcaaatataatcgttcctttaacagaaggttcatttcgtcttatcctaaggaaaggaaaacattcaaaacaatacagaagatcagtaatcaaagtgattttccgtttccccacacaaacagaaaccaatatgcaaacacatacttgtattccattctccccgttgtcgggtccaagatgacccaacgctcgttccattttctcagctgtgaacacaaaagcgattcttacatgaactagctttttttctttttctttctaaaagcatcaatcaataatatttggctattcaaacgattataaaacacgtaacaaaacagaacgcattggaattataacagaacatcgaataagaaattaaaaattggaattgggaaaagaaaaggagtaaaggcgaaaataaagtgaaattgaagtgagaaataggaaataggaattgagataaagggagtgaatgaattacggtttcagatctcttgagaagtggtccttgcaacaggtttctaccggaagcggaagcgagctggcgcttgatcttctccaagctattctcggtgttttctgcagctcgctgtgtcattgcaaattcagctcagtgttattaacagcgattcaaaaatacacaacacgcaacgagagtgagaaagagaaggtggcgattgatgagttaccggagaagccatgagcgtagatcaagactttgtcggaagctcaaacacaaagggttttgggtgatattcccccagatttgcgtttacgagtgtttgttttttactttttacaagaaaatattgaaagaagaaaaaaaaaaagtttaggaaattaaattatttaatgggaaagaccggtaggttattatttggcatactgacttgcagttgtgcagttagcttcacttttttctgtgttggtcaggattaataattttaataaaattaattttgaataatgaaatacaattaagaatgcatatttaaatttattttgtgaatttaattagaatgataccacagtgtaaatatttattatgcttatcatcgtctgttgtgtataattaaaattgttgatttttataataattattttgtaattttacttaaaatgatttataatcagtttataatttaaaaattaaaaaaataaaaaaaaaagtttataatgtaaaaagcctttaacaaagagtgtattaaaattaaacactaattttatattaaaaaaacatgattttaagttttttaaacattttcaatgtatatagttacactattaattaaagtaagagtttgcattgataatatcaagaattttacatcacttgacacgtacttcttgttctcagtttggctttctattaataatacatcacttggcttataaaaaaaaatataaagatttttatatcatcaataaactagtattttaacatgggtgggaaaaatattatttcatacaactagtttataataaataataacttttaaatgtataaattatgttatattatatgttataattaaaattcataattaatgaatagttttaaacatataaagtatattttaaatttgtaataaataatttatactgtgatatagaaatattttgaattattgataatttttataaaaaattgaaatttaatttaaaaataaaaacaacaataatattttgaaacaaataagatgttaaaaataattcttaaaaacatttttattgaagaaaaacttctagaaacactttcgaagaatttgaagaatagatcttccacccatccccttcactttccaccaaccaaacaaagtgtatttttgttttggtaaaattaaactttaggagaaggaaaatgatgttttggtacaagacacaaaaagttttgtgcaaaaatagagaaagagagaagggagaaaaaaaaaaaaggccatacaccttttaatgaataaacaatcaatttagttttaaaaatattactaacattaaggaaactaatttgaagaaatgttcaatactaaaggaactatatagcatgattttcaatgctactctaatctgatctatatgacacggtaggaacaagctcacttgggaaaacaagcgtccaacagcttttcagattattttttaatgctaaacaatatttgtgtgattggactcaaacaaaaggtttcaataattatgctaatacaaattaaaagactattttttaatgctaaacaatatttgtgtgattcgtcaaatgcaacaacattaatgccgccttccatgtagatattaatagcactagttggggcatttgttgtagaggcaaccaaggcaatttcaaagttgcgatttttgacagtgaaggtcagttctttcctattgctgaaagggaggccttggggtcattgaaagcccgcaaatgattattggagaatcacttttgtagagtgatttttgaaatggatagtaagctagttgtagataagatctatagtatgacccaagatttttttgagctgtttcattattcaagagtgcgcatacatactcaccctcaatccaaactatttgatgtagtttatcaagaggcaaacagactttgtcactcattccattgcaagggtggcaaccgattatgctagtctcacaagttttgaaagtatagatcaattacctttttgtattcaacaggtgatcatcaatggaagttcttaagtttgcttttgcaaaaaaaagggagtacttgtatttaaacactatttaagagagaggatgatgcttcaaaaacaaagtaaatggtttattttgcttttttattttcttacttaatgagtgagatttttaacgatataaataccttattctcgatataattgatttacttttgttcataattcacaatagacttgttttggttttgagtgagaccaagggtattcctcaaaaagactaataattattgtagttggaacaagaaattgtacatataatgagaatcaaacatatattatatcgttaaatagatcatcacactcatgtcatgggaatgtaacatgacttatatcattgtacccatagttgtgaaatctggttcggtcattgactcgattgagatagtggaccatggccctggtttgacccggtatattattaaaattttaaaattatatatgtatctattatatataagtatataactaatattatttgtgagtaagaaagatccatattcgaaaattaaaattaaaaaaatccaattttttcaaaaaaaaaaacgtttccattttttttatactagctggatcggatcgattcaactgggatccggtaaccaacctgaccggatttaaccaggtcaatccagatcaactatataaccagtccgaaagcgaaactgacccgattagaccaatggatcttgatctgacctatccaatcgaccactctaaaccaatttttataacactcattgcaccaaccttgttacaagtcacattagattattagattgttattagattattagattgttagtgtatataaaaaaatcaattttatatataaaaaaatctaacttaaaatatattttaaatttctaattttttattaaaatttgctttgatcgtttacttttaaaaatcttttatctctcaaatttaagtcaatattattcttccagaataatgacaaatgagtaaaaatatattttagcagaaaacgtattatttttttctttctgaaaatcaatttttcccacctttctctttttcctattccttctgtctttcattttttttttttattgtgccataatacagtgagtggatgtatgtgtatcatgtgtacttctgaatttaaatacagagtatcatctttcagttggcgctttttcattgtaaaagcaaaaaccaaaccctagacaaacgcccacgtacagtctcaaattaattgacagcaatactgatccaagtccagctctttcatccttcacttcactgatcaggcatcgaatcgaagtgaacatcactgtactcaagttgcacaataagctcagcattttgtcaaacagaaagcaggcgacgataactaatgggtgggatattgaagcaaccgggcgcgtttgcaatcacaccgcacaaagtatcactctgcatacttcttaagatctacgctccacccgctcagatatcggtccccttccctttcgcttccgttgctcagcacaatcgccttggcttgttcttattagccctcaccaaggtctccacttttttttctttcattctggacaaatgaaattgcatttcaatcaattctaccattttgaatttgaatttgaatttgaactcatcacactctggaaggagggatttttggtctagttgtatcgcaagcagcttgtgctaaatagtgctcgttttttttcttagcttctcgccttgtctgttttctcttaccgggttctcagtaaatacttgtagcagaagaaattaagaaggtagaatgaattaaacttttcccataagttaaaattattatgcattggctaagttatataagctctctcatttagcttctccaaagtccaaaagctaataattttaacttacacataagctaatcttaacttatgggagaagcttaattcatcttaccttcttactttctcttattgaagagtctattcaaataggatcttagttatctttgggcgtagtgccagtggaatgggcatgctattttaattgtttttagcattcccatattgtttgggattttttactaattcagtgttggatcacacattttcttcatactggtgtgttgaaaatgttgttaataatgcagtcctgcgattatatattggagccaaaattggatgaactcatccatcaattgagaatgatgagccagaactgggaggcttcctgggttattgatcagttgatgagcagactatcatctctgtcatcacctgatgatttgtttaatttttttagcgatatacgaggtgagttgatcagctttaatatttgctagcctttgaccctttttcttttttatatgttctgtcttgtttgattctgatagaaactggaccaggcttctatcagattccgtcttttatcctttttattttacttgcaagtagcagcgcatttggttattgcctatacgttagatcaaatttttcatatttactgatagtaagatgtggttcaggaatacttgggggtcctgattcaggtgctgtggaagatgaccaggttattttggacatgaacagtaacctggggatatttcttcggcgttgtgttcttgcttttaacttgctatcgtttgaggtatgatgttttctgcaatcttaagatggtttaaattgatcattgtttgaatatttatatgatcattatccatgtcaaaaaaaatggggggaggtgaagttgtcttctttgaagctccataatattgctaggtgcttcgaacaaagtattgttgtctcaagtaaattctaaatgatacctttgaatgagtttacattggtattactaaaattcgtggagtggggctcagcacctgttatcctttgttttcatgatgagcatgttgctattaggagtttaatgtacaattttgagtctctggttaatttttttttcttactcttttctcatatgcttagtttatatgtgtaattttcacttttcttctttagaatgaaatcttatcctcctcataacctctaatttgggtgtccagggtgtatctcatctcttgacaaacctcgggatctattgtaaagaagaattctcaaattgtcctgcctatgaagaacacggtttagatgattctagtagtaatctggagacatattcagaatatgagaatatggacctggagaactttgtctatgaaaaggtttcagaagaaattgaagcaagaaaggaggctagtgaaattgttccattccatcttcatacaccgaacactcttctgagcttagttgatggtataaggatctaatttaattgggctgcccttttattgttttctgtagttttgaaagcactcgaaaaatctagaccaggatatttaaccaattttccaaatctgttttctgtttctacacttgtttatcctgcacttctcttttgggtttctctatttatgccttgctcttggaaacactgtttgacacaatgacataacttcactgataatgttggaactcacatgcacagatattgatgtgcctgctgattcagtatccaaacagagtgagaaagttagagtagctagtccttatgaggatccttcaagtaacatgctgcgagatgttgatcacagcagcgcggtatttctgcggacaaactggcaggtacaagggtacttgcaggagcaagctgataccattgaaaagtaacaacttgtaaacttagaacttcactgattttttttttttttatttttaaaattaactgtaatagtgcatgcaattatattaaatttaaagttttattcatatattgcaggaatggtagtgctgtatctttcaatgggcttgaaatcattctacggcaactacaaaagttggcacctgaacttcatcgggtaagtttattagatttttttaatactattccttcaatatattagattttttttttttcatttttgctgggatattgactttcacttcaatccaggttcactttttgagctacttgaatggtctttctcatgatgattatatttctgctttggagaatcttcattgctattttgattacaggtaattaagcggttatttctttattcaatctctttgacggcattgccaatgtttgggttcacttgatgactaattacatataaagcaagcagaaataatgcatcattcatttgtggcagttcattgtcaattgatattcattgctacctcaataaccacaattgaccctcatccaacaaaattgttgacattgctagtctgtttgcgtgctactgaaggccattattgtcttgcctgcattctacttttttctaataaccttattctcttcatcttcaatttgacattaaagtttccctacataaattgtaaaccttttccttcatccatagattttgtcttttgctttgaattatagatctcataactatatttgtcctgtgtacatacccttaagggttgagtgacttaatagccaataaaaaggatagaggaacatcatattctgcaactgaacttgtctgttatttgttggacaaaagtgcagggactgaaggatttgattatattccttcagttagtggtagtggctttggaagatatgaaattggattattatgtttggggatgatgcattttcactttgggcatccaaagctggctttagaggtaaatttttttagcattttgattttgatacgtgctcagcattctaccttttctaatcctcaaggcttctataatttgtattattttgtactccactagtcattaagctaatataatactatacatttttttggtgtcacttatattggtttgtgatgtttaggttttgtcggaggcggttcgtgtttctcagcaggtaatcatacaaaaataagctttatttattaaataaaattgtgaacatgtattcagcaattattgcaaaacctaagctgacaacaaatgttgcctgtgcatgctatgctacaaggggtacatggcaacataaatgttgttggcaaatattgccatatgttgtgctgtaaaaactgacaattttcatttgtgcagcaaagtaatgatacctgtcttgcatatactttagcagctatttcaaacttgctgtttgaaaatggcatctcaagtacagctgcgacactaggatcgtcatactcaccttttacaagtataggtatttcgctctctgttcagcaacaattgtttgttctcttgagaggttctttaaagagagcagaaagtttaaagttaaaacggttggtggcttccaatcatctggcaatggccaaatttgatctaacggtaatgaaattttctgactactttagactaaacattctctttatactgctagtactttttctttatgaatcctaagcaataatgtaaatctttgttgtggctttagcttcttaaaatattcaagcctcaaatatattgacctgttagtataagaatatagtagagacatggaattgtgcaaattccagataatcaagttcatgagttacactgtggaacgtgagaaagagttatagtgagttgattaagatgagacctgcatttgagagtgtttgggtttatgccagggaggtcaaccatgaaagctttatgtctactgcagggtgtgatgtatctatactgaaggaaacaaaaagatccttgcataatcatcattgagatagatagagtatatgccaggatggcactagaagtcttatggaaggctttagcgaaggattgactttgaatccatattaatgttaaatggattgtaatagagttttatatgtggtactggactttccttgatatccgattggttagctatttaggattgaaatttgcttaaaatttgatcatgatacatttacttcaatctatcattaagtttgaaccctaccaagcaagaaagcattttttggggtgggaaaaatgtttctctccctgaaaggatcgagagcctaaatctgtcatatgatctatatcttaggtacgaactccgtattttattctctcaagtctcagcacatgctactgctcttgtttctattgctaccatgttgaagttcagagcactgctttgagcattccgggttgcaaacaaacaatcacttttttgggatggaacattcccatatgtgggataaaacataatagggatataagcataataggtgacactttccattattccatcagtttaccttggtattggatgtagttattgggcacattgaatagctagtgccttagtgtatgctttatgctgacaatacatgacagacatggttgtagttgatgaattgagagaaagaatgaattctaaacttgagtcatggagagtagctttggaatgaaaagatttttgggtaagtaggagtgacagagtgagacacaatgtgtggaatacaagttcaatgagactcaacttgagtgaacaatttcttgaagatgaaaattagggatcagatacatcatactcgatgttgcacggtttaggtgtgtcttgaaatatgactgtaattctaataaattttaggatctcatttgttaaagttgaatccatagtccatgtaccttacatatcatcattatttttcttatataagttatttcaagctctaccaacttaaattagatcttaagtcctgttagtgagtaatgaaacttgaaatttgtcttatgccatttacatcatggtaatatcttgattgcagcatgtccagcggcccttgctatcatttggtccaaaaacttccatgaagctcagtacttgcccagttaatgtttgcaaggttgtagaaatctttgtgattattctttggtgacagtttcagaacacaagaattaaattctttgcttaatctattttcttcttatatggctggcaggaaattcggttgagttctcatcttattagtgattttagctatgagagttctgcaatgacaattgatggtgcctttagtacagcttggcttaggaatttacaaaagccgacgggttctcttgttttgtgtcaagagaatggatctggcaatagttctaatgcttcccaattcattgcacaaccaacctcaattcctggatctgtgttgcaagtattgggttcgtcttatatacttcgtgcaactgcatgggagttatatggcaggtaaagttgctatttgtgttgagatatgtttatatgaaattctgaattaaggttacactaattattgttctatcttttttttggaaattgtcaactaacatggtataattgattaaaatttcattgctttaaggctaacctattaataaaagaaaaataaaacttgctgtaacaagctggcattgcttttcttgtattttttttttttttttgctgtttttaaaatgagagtctaacttttactgaattttaatccatatatcaatgttctattatgttaaaaccttgaatgtgactgttatttatttggcaacaacaactactccttccctttgctatataattataggttgagacttattggctgtgttagccatatcaattgttgggaaaggtgggaaagattattcatgggtcacaatgcttgaatataaaaaatggaagtggggatgtaaaaatagggccaaaacttggaataaatatataataaaggaactaataaattggaaagatgttacacacaagcacaccctctgctaagagatgacatagctggttttattggagcatttatgtatgggtgagtacaagtgtggtaatgaatgcaaaagatgaacaacaatcatggcctgaatgaatttttggaaagacattatccttgcagtctctcttctattgtaactattttcttaatcttggattgattttctgtcaaatgattttctttctcagtacccatcaaaaacattttaatggtattgtgccattctgtgtagttcttcatgtcaagcttctgggaagtgactatttttcccttttatggaaccaaagtttaaaagaggaaaattatccactttaattgaagacaaaatactcgagagagagagagaaagagagagattcagacacatacacacacatatctctgtaatattatattcttaaaataaattagcagtcatttctatttataattcatcagtgaaagtaaaacattttagttgctattaaggtcttgcttaccaaacattcagaagcaaagttcacccaattttttctattttagggtttaatcaggtgaactatggttttcaaacacagctggatacatcataagggtatactaggttccatcttgaccaaaattccttaagccctggttgtattttaccaaagttatgtttataaataaaaagggattgcatgctttatctttgcagttttttaatatcttgaaagtttgctgtatgtatttcacaatctgattttttttttctttttcaattgtcattagctcaccgttgtctcgcataaatgcgctggtgcatgcaactcgctttgctgatgcatcaaggtagtttctgagctgaatatattacagagatcacattctaagttgttattatcacctttgtttattatgaaaaataactgtatcaccaccattttgttaaaattttctgttgaattatcttttggtttccccagctcatcagatgcagcattagcatatgtaaagctcattcaacatttagcagtatttaaaggatacaaaggtcagattcgttgcataaaattgaatagaattccaccattttttttaaatattgtatgtgattgttttcaaatttgcatttgttttatcttggttttgtacttttgctaatagtttgtaagttgccagagtaactttttataaaaaataatatgataaattcagcttaatggcaattatttgctgtgcaaattgcattttgttaatacagagttgtcatttttcttcatcgagattgttgatagtggatagaaatgtccactatcacccattcgagttccttacctttgatccctcttattgttctgacttcttcctttttctttgtttctagaggcctttttcgcccttaaaatagcagaagagaagtttctatctgtctcaaaatcgcaaatcttactgctaaagttgcagctgcttcatgagcatgctttacatcggtaagttacctagttcatttgttgtattaagaatcttgagttgtgttagcatctgcaatttcagctcacttaattgagcatcatgtagtggacaattaaagctagcccagaaactgtgtgatgaacttggtgttttggcatcacgagtaactggtgtagatatggaactaaagacagaagcaagccttcgccatgctcgtacattgcttgcagcaaatcaattccgagaggttttttttagtcttcttctatgtactaaatattaaactatatacagaaaatcaatcacacactattcacagtttgattcttgaatttatagtgcatacgttactattgttcttttgttggaaacatgggatcacactcttcaaatatattctgttttacaagtgtccttgtactatatcatttaaaaaaaagccttaggttgaacaagggatcataccctttgagtatattctgttttaaaagtgtccttgtattgtatcatttgacaacagcataggatttgtagatttcaagcatgctgtatgcaatgctgttattgttatgtattaaagtacagtatgtggggatcttagcttccttgccccataaggagacaaaagggtgaaatcaatcactgttacctaacagttgaacatttaaaaaatttactgtttaaaatctgtatagattgcttttaattttcatataatgattcttttaggcagctgctgtggcacactccctcttctgtatgtgctacaaatacaatcttcaagttgagaatgcttcagttcttcttttacttgctgagattcacaaggtaaattatcatattgtctaacacacttgttagtttcatgtggtgtggatcaactatcaaacacttttttatttcattttgctttatctgtatgatcatttttttttcttttctttttatgcttgatctatgtctcatcctaaattaccggcaatctgctacattgtcccaaccctagctttcacattgttgtgttctctactgttttttatttttttattttttacttaaagctttcattcatttgtttttatcagaaatcaggcaatgcagttcttggtcttccatatgctttagcaagcctctcattttgcctctcatttaacttggaccttctaaaagcttcagccacacttactctagctgagttgtggctctctcttggatcaagccatgcaacaagggctctaaaccttatccatggagctttcccaatgattcttggtcatggtggtttggaactccgctcacgtgcctatattgttgaagcaaaatgctatctgtgtgattcaaacttcaatggtatgtcgctgtaaatagttgatgttagactatgctcttcaaatttgttgtctatccatgtatatttaaacatatgctgtttttgcaagtatttcaatacaatagccgaatttctgattctttaaaaagataataatcgaatgggggaaactagtttccccacattttcgtcaatagttttctgagggtgttggtcctttttctccccccttgttggggctttaactgaatcttacttgactgatttgaatttctttttcagtctttgaaaattatgagattgtgttagattcattgagacaagcatctgaagaactccaacttttggaggtaagcaaactttctgccttttaatcttttttgtgtaatcccttgtgagaggaagaaaaatgagaggtcatgtgaatgaatctgtgtgtcttgactacacagtggaggctcatatttgtaattagaactacaaatacagtagagaattgtcatataattatactactcataatatccctaatttacaatacttctttaacactatattacataattacaagcttccgaacagtttttattggtcccttttcatttgtaagcctttttgttgcatctctgcctcccgtcaaagttcacttggatacatgattgcatgcatgtgatagatactagagtattgtgtgtgtgtaaagcgtaaaatgaagtagggttgactgttacaatgaaaatccagtgcaaaccaaaagcagaggcatacattatattcgggcatatagatactagataagtgtttatcaaattggatttatggggtcttaatacattcaagatttatgttgtgatggtgaaagctcactagtcaactagtaaaaaaatttcatagtaaaattgactcatttaacccattattttaaacaactcttcaacacccaaatccctttctattgctttttatttaagatttgattttcttgcagtttcatgaactggcagctgaagctttctatctgatggccatggtatatgacaaagtggggcaattagaagaaagggaagaagctgcagcttcatttcagaaacatattttggctctccaatcctcaagatgaggatgatcctcttgttagtgtgttttgattgttctttatagtttatacctaattttatctatataagcttatttaattaaatttatgtacaatagtgacccctgatcttctgtaattatcattcaatagctgtagtcattttgtttccaattgtaaccgtagccaagatgtacggtggcataaaccttggagatattttgttctctcttccctttatagaggacaaccgttcactaatggacatacaaacgacaattagattatttatcattttaaaagattagatattttttcttaaattattcttgtgtattgaaatctccgcctcatggaatgagataatattaattatgaaagtataatatagttaataaaatttatatttctttcaaattaagagtatctaatgatttattttaaaattcttacagaaaattttcaattagacatttgtaccattagagaaaaactgtaggactcatttgtttattagattatttctgctagcaactgactcttttatacatttcatttttacattcctttcattatgcattattaacagtagattgcatctcttaaaaaaaaaacattagattgcagtattgctttggaaatatggaattataatgttaaaatattttaacgaataacgatgtgtagcttcaagttcaagaaacgttatacagtgcattaatgtttgaaattttagtgtataaataacgtattttttataatactttttacacaacaattcttttaatttttcttatcttatttcatttaactgttctcttaaattttcttatctttatttcctttctttttacacacaaatgaatcccaaaaacacattgttgggatttatttgagttcttaactttaggaactaaagtgacatgaatatgtaaatttaaagactaaattgactacttacaactaataaaaatagtacatcggacccaccctacttcaactcgtccataatattttagttagtacgcgcaaatctttatttgctgaaaagaatagcaacacattaattttttaaaactgcaatctttctataaagagaatatatactaatttactagatgagtatattttaatatattaatatacttcaaaaatataaatataattcatatttctcaattaattgtaaaagtactgtattattacttgtatgcaaaatattttttattaattagcaaaagaaagacacaaatgggtacccaaaatcacatacagtgccatgtatatagtgtcatatatataccaaatatataataatttttttttaaaaaaaaaaaaaaacaattctagaagaaaagggtgtgataaagccaagagaagcgtgtgaagaagagagagtggaatgtaaggtgtaggtgataggcatgtaataataagcaaaaaaagagtccgaaaggagtacatgaacatcatccaatccatccacgtcgaaacagtgtcgtaatctatttccatttcttctctatcttcacttcctcgtcctcatcctcatccacacctattctcaacccaaacgcaatgcaaccttatgcgcccactccccgcaactcccattccccttatatatcacaaccaccaacctcagaaccagcaccgcaccaatgccattacccaattccaataccatgtgcaatcaaactgcctttcagctccttggtttcaataacttcgtccgaaccaatcctaaatcggaccgctttcaagtcaaccgcttccaccacatcgagttctggtgcaccgatgctaccaacgccgcttgccgattctcttggggacttggaatgcctattgtcgcaaaatccgatctctccaccggaaaccaaatccatgcctcctacctcctccgctccggcgacctctccttcctcttctccgctccttactctccctctctctccgccgcctccgctggtgcctccaccgccgccattcccactttcgacgccgccacctgccttgccttcgctgccaaacacggcttcggcgtccgcgccatcgccttggaagtcgccgacggcgaagccgccttccgcaccagcgtcgcgaacggcgccgagccggcgtcgccgccagtgctcctcgacggccgcaccggcttcgcggaggtgcgcctctacggcgacgtggtgctccgctacgtcagctacaaggacgccgcgccgcaggcgccacacgctgatccgtcgcggtggttcctgccgggattcgaggccgcggcgtcgtcgtcgtcgtttccggagctggactacgggatccggcggctggaccacgccgtcgggaacgttccggagctcgcgccggctgtgaggtacctgaaaggcttcaccggattccacgagttcgcggagttcaccgcggaggacgtgggaacgagcgagagcgggttgaactcggtggttctggcgaacaactcggagacggtgttgctgccgctgaacgagccggtttacggaacgaagcggaagagccagattgagacgtatttggaacacaacgaaggtgctggtgtgcagcaccttgcgcttgttactcacgacatcttcaccacactgagagagatgagaaagcgaagtttccttggtggatttgagttcatgccttctcctcctcccacctattacgccaacctccacaagcgcgccgctgatgtgttgaccgttgaccagattaaacactgtgaggagcttgggattcttgttgacagagatgatcagggcactcttcttcagattttcactaagcctattggggacaggttcctcattttctgcttctttttatttccatttctcttttttatccgtgctaaacaactttattataactcaaatcttcaactatcactgaactaatcactcttaattnnnnnnnnnnnnnnnnnnnnnnnnttttttttttttttttttttttttttttttttaatttgattttcattttttttaaattttatttgtacaattatattctattaattaactttcaataattaacaaatgatggtacagtggagtgttatgtcagaatggatgtacttgatgtagcagttcatcagagtgtttcccctctccaaattgtacttatgtccctttcatgagataaaaagtttacgacattgaaaaattgttagataaaattgcaattatatcttgaatttatttatcttccgctttgaactgattgaaagtggtaaaagttagattaaccattttacagtttgtgtgttggaggatggtgattagttaaatgtgttttgtgttgaattgacaggccaacgatattcatagagataattcagaggattgggtgcatggtggaggatgaggaagggaaggtgtaccagaagggcgcatgtgggggttttgggaaaggtaatttttccgagcttttcaaatccattgaagaatatgagaagacattggaagctaaaagaactgcgtaagcacattggaagaacacaaatactcctttgttgaaatgattaatgaggaatcgatgtggcatagggtgtttatactctaatacataatagaattacaaggatagtgtcttcccttgtatgaaaatgaaatcacagaaactttgatggatagtatatttctattaaatactttgagagattacttgatttgtttcctctgatggatacgaggcgtccccaaccacaactttatctgcctctctgcttgtgaagtacactttgggggattccatgagtaactcatcttgaatctcccagttccacagcatcccactttttgcaactatcatatcattcaagtgattatggacttgtttgggtgtaacttctttagaaatatttctagaagaaaaaaataagaagaaaaaaataaaatgaatttcttcataaattaaaataagtttttcattaactaatttgtaaaggttatctcatctttttaaaaagttatattattgagcttttaaaaattagctaatggaaagtttatttttacatatgaaaaagttcatctcattttttcttcttattttcttctcttaaaaatgcttctaaagaatcttatccaaacatgttctatgtataatagcataataatatgaaaagaatgaacttttttgagtgtatgagtgaaaggaaaagatacaaagaaagaaaatgacagatgtaataaataatataatggaaagaaaaaaaaatgaaagtgaaatgaaaaagataatgagtatatgatgattataactcgtaataatgtcggtttcatgctatttaacataattttttagaaagaaaaaaaaagtaagttctattcattaatcgctatccacatgatgttgcgtaagatacgcaccaaactgaagtttaatgcatttaattgcatcaagcaacaatcctaactaaactttctagatgtggtgatttttatgatatcacaagttttcctgacagataaatgataaggaatatggttttgaaccttgcatagttcaaatgtgtttttgtagtgaatccaagttctcatccaaaggaagagaagctaaatatataacaatgatccaatgaaactcaattttcaattgaattacaatgccacaatatttgttccttcacacaaccatggaggtgtacaataatatggtgctctccaacagcaagacaccctaagatcacaaaattcctgaaggaaaaatttcagcaagtaaaatgagaaaatcctcatttgaagtggcattgtcaaactcagttcctgcagagacaaatcaaacaccattacactagtagaaaaatctgatacaatatataaacctggatccaagtgagtaggaactgcagtgtttagaccaaaagtcttagatatgtaatcattgtaatgagaagcaatacaatacaaccgtcagaagtttcgcttgttaatggttggaatgttgtttacctgaatccactgagaagtagtagtcttcaaaatactgcgggaacttgggttcctggtgaatatttcaactaagaagagccacacatgacacaaagtatataattttcacattagttttaactagttttgatgctaccaataagagtgcagagagcttctggtaaatatgctatgaatgggataagtagtcatgactatgactcatgatatatatcacagaaaaagttacaagacttttacaaaaataaaataaataatttaaaatgatttttccgttgccgggaatcgaacccgggtctcctgggtgaaagccagatatcctaaccgctggacgacaacggattttctgtacgagtaggtgaacaaaatagtaaataatttttatgcataataagcttgtaatcttgagtaataagactatgatagtgcagcagtatttgcatatatttaaggtttttaactcacccttagaatactggaatagattatgccagtaacatataaaaagtatttggcacaattcatcatgtctatttatttttcttttccttttattcttttttttttcttttatgaattgaattattgaaattctctcataaatataaaattttaatcagacatgttttgtaatttacccaaaaataatatttttacttatagtactgatatgtcaatttattgttgatattgaatttaattaattaatgaagcagttaaacatttttgtagactaatataagtgtatatttaaattaagaaaaaatgttatcaaaagtaaatcaccttaataataaattgtttatgttatctatccaaaaatgttttaattgatcatgataatatataataacagattgttgtttactaggcttgttgtccataaggatatcctttaaataggatgtggattggcatagactgtcataagaaactaggtactagacttgttgtttactctcatatgcagatattaattaattacaagaatatccatgttcccctatgaggaatcctagaggcaccaaattccttctacttagccctaggagtgagtgaacaacgaaagacatatcaaggttgatccctcgaatagttttcttagccttctcatcacttgcatatgtcttaagaagacacaaaataccaacattatattcctccagcacaactttcattagaatgaaaagctttatacctcttgtacccttacaattccaacgaaggacattcattaagaaaaatggttattagagggttttaagcaataaaggaagacaaaataactgtattgaggccatgtgtgcctacccttgtgtctctagaataggaggtttccttacgacaaatgagttctcttgggatgatgaggtcgaagtaccctaatgaccctagttgcattgctttaatgaaagcccttgtctccgcattgggaaacaccacgtgagtgataagatttttatccaatttcatgatccccttttggctttcgcggacccattttgttgcatgcaagatgcctataccttgctcgtttttctttctcgtatacatggaagtctaggacacatatcaaaccaaagagtaaaacactaactaacaaaaataaaattattattaatttttataaaacaaaaaatatcacatattttaacaaaaaagtctcatacattgataaaaagacttaacatataattttctcatttaaagaatttttttcttaatatttatcttaggtctcactccattatcctggttgtccattgaatcggaatccacccatagaatacttgcttttgttttgatttcaatgcgcctccattttggtcgttacctttggaatcataaataaattttttaacacccaatttgttacctaggtaatccttttccacgaggcagttggggatgttctcccctatgattgtttcaaactttaaccaccatatgtctattaattgtagaattattctggctatcacattcgcaatgaatacaaaattattatagctatcatttgcaataaacgtgacatcttggtactgattcaattttgaatcttgatctgatttccccttttcgatctgtttttttcatgagcttcacattaatgactttcaaaattttaacattaatttttgtgccccttggcatcttagacacatttttaccctttttaaccaccatccatggaccgtataatcccaccttatctttctccaccttcatagctttcatggtagcttcctgctggtgattgtgttgggacatttaattgttgtttgttcaatccctaatgttgcttcactacattgtgagtccactttcatccctcaaactgttagaaaacaaaagtttttttttattagatcttttttcttttcattggatcctagcttagatttgtgccaaggttttagacaaaaagaaaataacatatttatctgaatatcatttattagttatttgttgaaaaagtatcttttgaataattgaacgccatatacatgtatttaatatatatttctctcttccaattcctataatcttgtgatcatttggaaaattgaaaaaaaaaaacagtatttaagtaatatttttaattactttcaatgaaggtagtataatatattttctaagaatggattggccgggttctttatgatcgtacttgccataattaaaatatattgagtgaagcccttcgtatttcaattttagaatctaacccaagacattgattcacgatatattctagctttcttcctaggtcaatttcaacatagattctgcaaaatctccctctggagtgtataaagttagcatatcgatttttaaaatggttcccagctttggacctgcttaccataagaacttatcctcatataattcaatggaaagacctagaatgtagatataaacatcaatcttgtagtctgctaaatatgatataaccattagaggggtcacttgttttaaggaaacatatgtcatgtaatatataaatgggcatctcttataccctttttggttagtaattttgctgaccaaaaaaaaatccatggtccttcaaatagggcatgccattaatccttctttaccgagaactaattaaactagttagtagtagtcttgcgacatattgataatgcgtatagttcccattttagcccattccttgtgtagcttgtgttcaatcataattaaaactatctttcttcccaagacatcaacaatatgagagttcttccgggggtcacaccattattcaaattcttccttcgagataggaattattattggacatagttatagctttgtagcatcattattattggcatactcctaattaccttgtaacatctaccctacgagtgttacgttccatatcatctacaaagctctggaagtttgccacaatctctttttcagcctctaacaaggtatccaaataggactttggaaccttatctttctacatattgtctttgtctctgccctcagtaataacctcatctatcgtaatcgaaccttccttagtcttaacctttttggtactacaggtaaaagagtcttcctcttcttccttagaagtcttagcaggaaccctagcatagctcttcacctccctcagtcttatgccttatcctttatagttgtatagatgttttcttggctttcttcttatttttaaatgttttatatagccacattcatggcctaattaagaaaaaaaatcattctaaccattattagatcataaccgtaccactttgcagttgcttttcaactatataggtaaattttatttagtttcagaatatatagttttgtaatttattaatataaaagtatatgtgtaaaaatttgctggcatttgatccttcccttagatgttattgaatttgcccatgaccgatcttggtttactcgttttatctagggagaaattttcctaatatagtattaaaagactacgtagaactcagttttttttatttatctggattgtttacaaagcactattgaattcgggcatgacaatggatgagaatcgagtttttgctatatagaatttatggtctcctcaagagaatcaggtcacccgattttccgtcttttgttattattattattattattattattattattattattattattattattattattattttcatagtttgagcgtagacttactcctgcaactgcaagacgtggtcacttcctttttgaaagctttgttagtatataccttaactcttgtacacctttagcttagttggagaataactctttcatgtgtaaaagcaattaattaagcataaatgctaaaattcaagggttgctttgaattaattcaataatattagtaataataagaatacacaattttttccattttacagtagaagtaatttctttcttgatttaaaaaaaaacttaaataattaagaattaattagccccggccaaatcaaataaaagaccgaaaaggaagcataaggaggttacttttctgcgcgtaggcatgcttgctacggtgctaccccatatgtggttcggaagttgatatataaattagtttattggcatggcaaatcaatttgagagatcgagtatatatctgtcaatatcttagtgactgtgacaaggaccatgaaatacccttatgtttttgatcatagaagtatatatgacttcattattaaaataattgatagattacaaaacaaacctaaccttgtttgatttaaagtccaagctggtgtatgcatgtttcaagctatattaatattgtattataagggatgatgttttcagaaatactataacaattgtttttgactaaattcaaaagtatgtttgattaaattttaatattttttaaaatttttaaattcaaaataatgaaaataaaatataataatagaaatataaagtataattagatttcgaaaataaaaataaaacttttctgtacatatactcttatgatataaattttccatatcttattataggaatataaaaaaaaaagatgttattacttatctgaacataaataatatttaagaatacttaaaaaaaatataattaacatgtaaatattacacaccaaaattcatatgcataagaataaagttttaaaccttaataaattcattccttgcattaacaaactcaatacattatcaacatgattaaaataaaattacactctaattctttaagcaaatattttatattaaagtactgtggaataaaaaacaaaaacaaaattcactaaaaatatttagttagatttcatgataaaaaatattattaacaaagtcagtaatacttcatagttatgatatgataaataaaaattcaaccgtcaacaacatcaataataataataataataatctttcgtcgtactttctgcatatgtacttgatgaaaattaaatagcgtcactgaagcatgccacttggcagatatattaaatggtaaggaattaaatgccaattgcatgccgcaaggacttatttaggttaattaatctcatccaaccggtgaagagccttagagccctatatatattaatacatagtcttctgtaagagaaagcaatagcagggaagatcgatcgaaatggaagaaggtcgcaaagggtatgttccagtgctagtgggcaaagggggacacaacgtggagaagttttgggtatccatcaaagcgattcagcatcccaccattgttgagttgctggatcagtctgcagatgagttgggataccagcaaggactcctcagaatcatatatgatcttcacaacttcaaagccattcttcacaaggcttccaagaattgtatctagcaaattacatccatgatgtcttgtttttcattttctgttaattacgacccattctcaaacatgttaatagaaaataaataatgaattattacttgctcgctgtgcattcaactttttcttctttttctttctttctttctttatagtggaaaactaaacacaacttttcccccctcattttctccgaattattttttcttgctaataacatctacttagaaatctgactatttttaatgaattttttttctcctaattatattttttttccactcaaagacttaaacataaaattttactcaaaagatccaaatctaattctactcgaatcataataatgttagaaagattatgtttatttgaagggatacaatatattttttaattaattgataatgtaaaaacttatctaccaatttttctagatatatttatatataggtaaactatatttgagaactagtaataaagtatttaatgttataatatgaggagggattaagttaacgtaggtaattttaaaagagatattcttcatttgtgtcttttcttttcttttaatgaaagggttctaacaagtaattaatatatatatatatattaaatatgatagataattaattaaatttaactttattcaatacaaaatatttattagatttaaaaataaaatatatatttattaaatgtatgacttttcttataatttatataagtcttgttaaccattgtccttggggtattggttaagaaaataaaataaaaaatatttagagtaaaaattataaaagagagcaaaaatgatcatgaacaacacaatttttcatctctcaataaaaatattttcactttaaagtttttaactgatatactaagataattggttaacattagtatttgtcaatctatacatattaaaaagtattgttaaataaaaagtgaacggttttttatacatttattgttgcatttaataaatacaatgaatctacatattattttattacagtaattaatatatgttaataaatataagacatttaatgagattcaaacgtacatcgaattgcatatgttttagaaacagtacattcacaacttatatcctaggtgtatttaagttgtaatttgctaaagtgttccttctcacatgaaataggtgcatttcaaggatttgttgacataaacccatttgtattgttggagtactctggcaaagttcatattgggtgtattttaaggtgatcataattataacttgttaatgtttccattttaaaaaaaatagtaagggtatggttggtaaatttctatgcataaatttatttgaaacatatggtattggataatgagataatacaatcaagtaaaaatgaataggacaaaactatcattttttttgttgataaaccatgagacaatgttttgtttcaagtataaatacttaaaagataaaaaataaaaaaaaactcatttgacttctcatttaataattagattttttatttcttttccctcatggttatcaatgtggttagcatcgtcgttactattatcacatttttttattattgccaccaaatcatcgcactcattggcactattattattattgtcttcattttcattatcattatcatctttattgtttacaccacctccatggttgtgcatttattttggttattctcattgtgattgtttttactaccatcattattattgttattacttttattatcacctttttgttgctaccaccctcaccgtaactgtgtcaaattaatataattaatatgaaatatattgaaacaattaatattagtaaaggaattatgataatatgcttgttaaaataaaaaaatgtatcaatacctaaatagtacagatattaacagagtacttaatattgttagtatagtatttttataaatatataaataatattattttcatgtataatactaaatatttatttaattataatacttaaatgaattttaataatattattaaatattatatttatcaaatataatagatttattgaactaaatagttatcatagatgtttataaaacatgtgagttttcataccagtcaaggtattttatatatattaaacaacagttatttattatagaattcaatacttatatatcagaattttgtagcttataattatttctcaacagatttttttccttagctattttcatacttttttactgtgtaaaatttgatttgttgttgcattctaacaaaattaattatcttaaaatcaattttatgattatgattataatctattatatatataattgattattaaaataatttaattttttagctatcccaaacacaccctagctattctatttaataattaaattaattttataattaattttaataataataataataataatattattattattattattatgaatatagtatattaattgcattaaatttttataatatatgtttatatatgtttattaaacatatggcttttcatattagtcaatgtattattaaatacaaattaattattatagaatttaatacttatatataatgaaatatactttaaaaaattattgttgttatataattttaaaaaatatactttataaaacatattttgaaataaatataattttatgaaattataatttattattgttgttagaggtgttgttcccaactaattgggcaagttaatgtgggtggacaacgggtgaagctgctatatttagcttgcaatggcttgagagaagaatatcatttgttgagaaacattattaattactacgaaaacaacattcttaattaatacagtctgttaacatctagtttttcaatatcaaaacatcgccattttttatttcttgccttcaggaatgttctgatagccgggaagcgttttgagcaaagaatatcataagattttagttgtgcacgttccatatgatattgttcatttaggtaaaatgtttactatattttcaattcccgttatttttaaatttcagttttattatttttttcttaatgaaatgcatcactaaaacgggaaccaaaagctaatatatattattgttagatgtggattgtattagttttccttagccatatctaccagtaatgtattgttaacaataaaagtaggagctacaaaaaataaatacaaaacagacaattactgtttagtccagccttagctaccatttgtaactttttaaaaaaaaaatcatttgtaacttgattagcctcttgtaacacatgtagccaaataatccgaccaatatgatgatacattatgaatggcttgcaccaaattaacccgtcatatatatatatatatatatatatatatatatatatatatcatttttgtttcaaagtttcaattaattaaaattaggattctcattagttatttctagacatcgcgtgtattcatttgtcttcaaaaagtcaatatcaaaactcacttgtagaatccaaaatagaggatttggttctaaatcttaattagatattcatttagaataaaaaaaggaaacatctgatcagttaacatatccgaaataaaattcatcactgaccaatatttgattcaaattcgttatctataacttagggcattttaattatttaatatagatatgtcatagatattcctttttaatgtggcatggctattaaaaattttgagcagcacattaatcaccgagagaaggtgacacagaagggagaaaagtccattggttaagttagggaggaaaactgaccaaacacaagaagatcgagggccttggtttttgatatgttagagcctagaatcactaggtcgtcggcttagtggtcgagggcttggacctttgaaataatatgtctgaggtcatagatttaaacatcagtacgatcatcgtaaaaaagagaagatatgttagaaccttcaacatggattttgaaccgaagcttgctgcagaattttgtttgatcaccaatgtgatttttgaatctgattgctttcagcttgtgaatagcatgaatagtccaaatacaaattaaataacaaaagttattttgcaggaattgttgcagattgcaagtatcttagtaatagtgccttgatatataaaaataaaataaaaaataatagtgccttagtttttacaaaaagaaggggaataaagtggcacatgaattagccaaattggctttcaattgggagatacattttgggtagatgaggtcccaaaacaattggaccttttagttttatcttatgtacagcttttatcctctgatttataataatatattcctattctttcttcacaaaaaaaaaaaaaaaatcaccgagagcaataatatccaactttgacggtatgcatgattttgttgattaattagtagtttgcacggctcaaactactaaaccaggtaggatttttaattatactttttcttataaaacttggcatttccactttccttgtgatatataaatattcccaatatcactgttgtttctgctccagaaagaaggccatactgatcagtttatcaatttgatgctcaaccgtaccgttgtcctatccatatgggatcttttatatatatcaattgatttaataaaggaaaaaaaaaaaaaaagcacaatgatcataagagatttataacactcatatttgttaaaacaaaactacgccttctgtgtggactctgtcaacattgcaatcaagtttatactcttgcaagaaagagagaaaaaactaagagaaatgagtataaaatattacgcaaccgtacgtgcatattgatatagctacatgtgtctgtgaccggatccctccagacacacacatctatatttactctaatatatatgtaatatgctcctgaaaccctagattttgaagtaatttgtggctagaaaaatgttattaattaaaaatcagtaaataaaaatctttatatttaactgaaatttttagtgtataatttttaacaaatcagtaaataaaaatcttttttaatattaaaattaactaataaaatattaattaaaagtataatatttaactgaatttaaaaacatttaaaagtatattatttaaatattaatataaaatataagaaatacgcaattttatatttacattttattataggtgttaatttgtttagagatgggataagttgggtatgataccattttttttgcgaataattatccaaaccaaaactcggcccttattaattacataaataaaaatcctattattattattattattgaacataatgaaaataatatctttgtttacagaattaaaataatatcttattatttaataaaattgatttccatcaaaataattttttttgataaaactgattttaacattaaatttattatttacctatttttataattgttctattttatttaagattattctataattgttgttattgttgaatcaaaaggacgtttacgtcttaaaaataaaccaaaagtcttaattattttgattggatgtaaataaatataaaggtaaaattagaacatttgttgttgcatgtggtataaccttcaaaatttcatttattactttttgtatatgagattgtgtttgcagaaatattctcctagaatttgtcgaatattatgaagaataaaagaagtcaagatcttatatgtcatcttcattatcaaaataagagctctgatacacacaggacctacttgcaatttctcttacacaagccttaaacaaagattcctatgcatgaggaaaggatgtgcattaaattcaccctaacaaccctcttttatcaaaagaagatcaaatgaagatttacccgttatgagacaacggatacttaaagacaatgcctatataaacaagaaggtttgaagactgatgcaattgacctcacacaaatattttttactcttctccttcaacaagactctctttgtactcactcttgtaagattagaaaaaagtctcaaaataccttgaaatccatgagagaaaaggactaagtgttatttttgtttatgcgtatgtaagacgattttgttttagtccctgagcaatcctcaatcataaattaaaacaacagtgacttggtataacaaggaatattggatgttgatcaaacttgggataaagtttgatttgtaagagacaaaagtgatggaatacttgtaacttgtgaaaaattaatagaacttggtggtttaccaagaacttgctttatccttttaattgatcttgagtctgaattgtttttcagtcgtttaaggatatcctgaatgcgatctcgtttgttatctattcttacaaaattatcctcacatataaaaaactttgttggtttggaaaagttttttacaattacgctaaatcacaactcaacctctcccctttgtgtgatatttgtctttataattgtaattagtttacaattgttctgttctattttattatttaagaaaatttgtttccattacaagaaaaatatgtattaacaagttaaataataacaattcatatataaatattacatatgagtattaatatgttaattttaaaaatattttaagataaaaaataatcaaaaaggcatttgaaaaagggttcaaactgattttctttattttttataatagataatgtgagcatttaattttaaaatgtacttcaaactgttagtataattttttttaagagtttgtctatcattagtgctatgactatcagatttaatgcattatctttaattctcttttatatcatgtatttttttcatatgcataaaattaaaactttataattattaattaaaataaataattaaaattataataaagtacatgaatatatgtaataaaattatcaaattatcaaatcttaataattagtattttaattatttataaagaaaactatattctttattcactctaggtaaatagttgtcataaaaaaatttaggtaaatagtttcatgtattttaattttagaaaaaataaattttaatttttaatttattgaaatatataaaacttaactttatctatatgcaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatttaaaaaataaattaatttttctaaagttaaaataaatgaaaactagttacttaaagtgaataaagaatgtagatttttataattaattaaaaaataattattcaaattttaatattatataacttgtttacatatatttatgtattttagtataatttcaattattaacttttgattaataattataaagttttaattttacacataaataaaattaatgataacacattaaatatgatagttataagattaatgataaaattaaaaacttaagataattggctaatttctattgctcatcaaagatggagttgcttaacccattttcatttgggttcagttaaagaaatcctttttttaattacataaatcatctagtatatggggttacttaaccccaaattttacttggaatatgttacaaatccctttaaaaaataattatgaattacatagtgagatcgtcactaaattggaaaaacaaaaacattcacgataaacgtatctatagttattcatgttttttttttatatatatataaaaaaagcataactttttatattagaataggcgtaaatgcaatacaactttacacatcatgtaaatgttctttactatatatgtgtctggttttgatttatggaagcatttctcctaaaccgaatacccgtagaagagcagaaaggagataaaggaaaccacacaagtcacgaggtgggatatattactggaaaatgacaatcatatctaatagcatacgttgcaccaaactaagatgcccaaagaaatacacgtaacatcatattctagtaaatggggcaatcaaactcccaccatggcatagcaattagctagacgacaaccacacactctctaaatatgtacctacatttagatattgttggccaaatattattatcataggcatatcctttgctttggttttgccttctccatccatggcaatgaaaatcgtgaaccacgaaacctttcatacctgcctcttgtcacttcctgtgactgattaatgccgtattctagtagataaggacatttacacatttagaaccttctcatcttatttggtatgttcagtccccttttcaatttgcatcagcatttgattccgcaatattaggtaaatgtaattttcatgtcatggccacttttaccgcctgcttatcattgggggtgtatatatatgtgtaacatatatacatcctttcaaaatatgtaagataataaccttctcattttgtaaaccagttaattgcctcattttcctctgcttcattccccactcttccatatatatattatggccttatatgacaacaatgatatgaacttagaagagatagatttggaggcctttgaaattgatgcggccatcctaagagaattgctagaagaagatcaagagggcaaggatgataataaggatcatggtaaagtagaatgcatagtagaatccgtagaagaaaacaatgctcatcctgacatgatggatagggagcaagaacagcagcagcagcagaactgtttggagaagtatgggtgccatgactttgagtggctcaatatgatggagccaactaatccactgaatgatgtaagaatgaattggttttcagatgacattgttgagatggtggattttggttatgctaatgaagaatgttactctcaaatttgtgatgggcttgtctctaatgaggcaagttatggtttcctgtgggaagattatgatatttaggtgcatattaaagtttacctttagctagctctagaagagaagaggggaaaaggggctaaaatagctcatgtgtgaaacaatctggttagtaattcgtaaattgaagaccaagttagcagaactacatgtgtaaatgctgtttgggtcaaattctattaagacataagtgaaagaaaaagacttataataattagtttaaagagtcgatttccaaattacttgctgcatgtctacgttaattaattatccatttatctttccttattttttccatctctttcattctatattctgcatgatagctgagaaataagatgaatgcttactaagtaatagtaaaatagagggaccttgctttgatgtctcattcaggacaatatctacatattaggacctatttggctatgagaattgataatgtgataactatatgaatcaggattattcagtggttcaaagggatgagtcaacctctagtatcaggaagtttagaacaaactcatgcatagtcaatcaattggattaaatctctgagtggattaaacctctgaattgattactcaattacatcattgtaaggtcataaatgcctattttgtgattttttttttaatggttttgaatttttaaatcttattatccttaccctttaaatttttgtagtaacgtttggttgacattatttgagaaggattgaggtgagttatcagagaagttgttagactcacgataaatgtgaagaagttattaacaacgtatttgatgaacataaaaaatattgacaagttaataattactaaggcacttttcccatatttaaaaagtttgaagcacaaagaaagattatatctaacattgaaaaacagtaataaggcttgggaattgccgaaatatatatgtacgctctgtatcttaattatgtatgactcgagtgttccatctaatcacattatttatctattacacacgtaaagttacgctcaatgagttgcaaatatgagttacaatagtttaaacttaaaataaataattttaaaataattactttaaaaaaaagttattcaataagcacataagattttcttttcaaaaaataaacaaaaaaaactattttttttaaacagaaaagatttaaataaacatacgaaaaaaaaaactacttatttgattaaaaataagtatttttaacaaataaatttaaacaaattaactcaataagtttacaatacatgggtacatgcacagatgcaaaatgggagctacagtacataacatcatgaatagttgtcaacttattcgccgtccatcttgattgttgaaattttcttaattcattttccaaatggacatatgtgaagctctcagactgtttccagaggccaatcataaaaaaaaattgatggcttccttcagtggcaattatgaagtaaacatatatccacgccaacacctcatgaatagttgtcaggtatctttagaccccgcgagaaatttggcaataaaaaatccaattgtatcaaggggagatgatggatcaaacctctgaacaaggtcttcctcccctggtcgtaaccactccctgcatagacatcatggtgtgaaaccaaaaattggcactgaatttttttatttattattttggataaaaagaaataaaaggtatatccacaaacaatactaaacagcatcacagatgagtgtgtatacaagatcgtctatgtaagggagagataaaaatgcacaatcatggacaaatggatgaagggcttactctatatatccatcagaaaattcacagctaccaactagacccggtcctccaattcttgggtgctggaataaatcaaatagcaaatccgaataactcaaccaagtgaactaataattcattacagacaaactaaacatcaaaatttgtttgtagtcaccacttacgcatcttatttataaattgtaagagggatcatccgtcaattaattacatatataatcaagatagtaattcagcccgagaattatagaagcctaatcaattcaaaagaataaaaataggaaattcggactgcaaagaattagcatcaaacctgtggtgccaacgacagatatttgtatttatccaaagcatatctaatgcttcattctcaccaggattaatcgtacaactgttataatacaatagccatcaacaaatcagtttaaaagaaacgtctcaaataaaaaggggtaaaaataaaacttcagaagtgcccatccaaagataacataatggtttgaggcagcatagctacaaaacaaacttattgataattgaaaacaaaaaatctcttaaatctttcttgtattaagctgtttggctggaagcaaattccaaagaagcaacttagacactaaataaaatatatttcagaccattacaaatacatttcaaaattactaatgtcatgtttagtttaggtaagaaagtgaaaggaaagaaaggcgaagggaagaaaaagaatggaaagtgagatgatttttaaggttgttaggtttgagagaaagtgaaagaaaagaaacatgattgtaatagaaaacttgtgagcatgcacagaacaatgtgatcaacaacaatgcatacttacgtggaatagacaattactcctccaggtcgaactaattgaacagcctggtcaaacatccttctctgatattttgcatggtttcttaaagattgagttgtttcctgccaaaaacaaatggcattgcatggttattcctctttttttttaaaacaacttttttgggggtaaaatttttttttatataaaaatgaacaataaaaactaacttaaccacccagacagggatgatgactatgcatcacattgaccgatatataattcatgctgacaatttcacaaattacactttctgggcaaaaaaaggtgaatttaccatagaataaatttttttccccaatcacattgaaataaccatcacttctacacattcctgtatttcaggcaaaggttaagatgtacacttatctgtgcaggatttagtagaaaaaactaatggtggtataaatcaagaaaagaaaaatgagaacacaattccactttaagataagccagtagtccccgtatcctctctatatttgcaccaataaatctagattggtctaagcatgtgtgtgtaaattcaagtaaatgcaggataaatttcaatacgcagatccacttctacctctccagcaaacaatcgaggccttaaaccaagggcagaacagggagcatcaagaagaactctgtcaaaactgtcaggagaaaaaccttttgaacgatcaaccctaccacccacacactgatttcttccaggtccatttcgtgctcttcgcatgttcttccggatgtcagctttgctaacataagctcctccatttgtttttttgcctttacctttaaaaattatttaaaaatgcatttgtaaattgttgatacagaaatgcttattgtgtatataacaaaatataaaacaggaaagtgacaaaccatagcacagaagaaatgagccaacagaaatccaataaatctaatcaagcataatatttgaaatcgttattcactttccagaccatttttaacactaaatgatactatgatgatgaggctcatgcaacagagacaaacaatgattcacagttctttcttttcagctgatgtttttctctttcatcttgaaaatataagaataagtttcttcgatctttgcatttagcaaacactactttcaacataaaacagaatgttagacaataagagtgattcggttagtgtgattcgatgtataattccaattcacttgatagtacagctttagcattgaataaaaatataaatttaatgtaatgctttatatcatgtgtaatgaacaagtcagcaagtagcaaatgaagacatataacgttcctctagagtctgagagtttaaaccgtctgtaacaaggggtgacactctttctacttgcaaatttggtgcaaacacttgatttgtcacatcaattttggaattattacagcacagatcagtaaaagtatcaatatcatctcttcgacaaacagatttaagagcatctaatttaaatgtctttatacaactcaagcccatttcagctgccaatttctgaatatccagcacctagacagtcatcaaaagttgatatgttaacaaaccattaatttattacaactctgcacaccatttaccattaatttatcatatttatcataatcattacaaaataaccaatattctgtgtatcaaaaatagggtacagaaatctggccaccaatgaaacttagaaataaatcagaaaatagaacaatatgttaatgcatgttaagctatgattccacaacatccagttactgtagtatacttgagttcaaacaagcatataggaatggcaagtttttgctaagttcagaatattcaccttattatgagatctatctgttgcaatgatctctccttcatccttcataagtattgcaattgcagttgttttccctccaggtgcagcacacatatatagtatccgctcacccttttgtggatctgagtataaaaaaagaatctatataaagaaaaaaaaattacaaagagatgagaggataaggaatcctcaatccttcttaaaataagaacaatagtaaaacagcaatgaaaagagaaaaaccaatagagcaaagtaaacaattattgtcattcagctttatcaatcacatgccagaaaatctaaattagtcagtagcggatgagaccatagcaagacctatccctgactaaaagggcatattttgaggcccacatgcttgccagaaaagcattatactaagacggttcaaatccaacttctctcagttgtgttttaatctggagtgcttgcagaagaatatagtaaaatattatttactaccaaggaaaacaaatggccaacaataacattgcatgtaaatcactccaaagtcagaaaataagaaatgagactctaatttatgtaccgaaagcatgagcagcaataatacttggcaggttttgaagaaatatttctccctcaagcacatctggaaaacagaaaaagaaacaataacacatcagctatacacatgcttcaaaactaaaaataattcacaaaatttccaaatagataaagagagcaaagataaatggcactcaggggattaacccaggagtgctagactatacagagtgggggcctctacagagggaaaaaagcattaaatagatgaagaacaaaacaacaaataaaagactgcacaggcagaccagaaaaggaccatatagaattacataagaaaactctggaaaacaaaatatccacagcaaccagattctatctcacctataatcacaaatctgtaggcttcatacaagctacacaagtctctaccccctccacttaccaagtgagagaccatgtcaaatctaatttcttaaagataatctcctcagatatgtataacagctgccaattcttatatatgttttgagcaatggaaaaagtatccaaccataaacacttgctaaaactcctaaagaatcaattattaaaacaatatctaatgttcttcactaacattccaaacagcaaaagataaaggcaaaagttcagtatacgattccaaaagcagagaaacaggtttcaacactccttgatcaactcgatactaaagcaacaatcattatcaacaccaactaatgagattatagtaatcttaaactaataatgtgttgaaattcagtagatcagagtaaagatgtcttccttgcacaaatttattcggaaaaaaaaaataactttgtcatgctgcattatatcacaccataaaatttcattcctagatgtgtagagtaattataaattcgtctcaaaagataaaaatatcgctaatgaaagagcatggcacattagagacaaatttgtcaacactctacatatttaggaacgaaaataactacttatccaaaatataatttaatcttcatctttcctcattttttaatcgttgcaagcgtaatagtacaataaacacttaaaaaaataaacataagttagaataaacataataataaacataatctgtatgttgttctgaaatttctattgtgacaatatcttatcaaaaaatgagactcaaaatctcatttttgggtaaggtactgagatttcagagcaacagacatattatgtttattaattaatactattatgtttattctaacttatggttgcttttctattttttaagtgtttattgtaatgttatccttggaacaattaaaaaaaaggaaagataaagattaaattatattttggataaatagtcattttcgtctctcaatatgtaaagcgttgacaaattcgcctttaaatgtgttacgtagattctttcattaacggtaacggacgaaaattaacatatggatggatttgttacactttttccactttcggtgactaaaatttaaattttcatttttcaggacgaatttgttaacactttacacatttatggacgaaaataactatttacctaatttaaaatgtaaatactatcaatgttatttttttagatctttaaatacttttgtttcgattttagtccattttttaaattttgttgtgaattaacattaattgatctgacattgacagtcattcaagaaaaaaaagtacattaattattttatcaaatttcttatttgatgacgtgataatttaataagttgtcatgttatcacttgataacaaaaattaaaacaaaaaaatacaagaactaaaatcaaacaaaaaatatttaaatgattaaaaaaatatcatgttttgaagggactaaaagattatttaagctgcagaaatagatttcgttcaagaaaacatactgataccaatatattaatggaactaggcttatattttaatcagatttcaagtccaagttttgtggattaaaaaaatatagttgataaaaaagatccaagtataggtggtcaattaaattcttaataaagattagttgttttaaaagttaataaatatatcatactaattaaatagtgacaaaaaataaagcataaaaatattaagtttacaatatgaataaaatatcaatctaacatattatacctccaactcaatgcttccaatttttttgtgttaattatcctgttcatcaagagaaagattttgactaattcgaaatttaaccaaaagataaataaaatttggttaataattatttttgtcgagattaaattcagataatatctaaataattcaattttaatttaagtatatttatcacttatgtctaatcattattgatttctgtggtagaattgacatgctttttaaaaaattggctccaatcttgcaaaatttccaccttattctccgctgattttgctgaccaaactatgtacagggacgagttcttaaccttgccatatttggattttttttttcttgaaatagtagtgactgctgcagctttgagtgccacttacattctaataactgaagttgatgttcaagatgtcaattctctgggtcatgtgctgtatacgagaacgagagagttaactgaaactatagtctctagttgggcaattcaatttaatgatggaaagaaatggaaatcaaacaagtattgatcgtatttataggataaatatgaaataaatttagtttgttgactaattttaactgccgtaactttaggacataaagagttgattgaatagatagaggtaaatttaagttgtgataaattacaattttttatacaataaaaaaaaatcttcgaacaaggtcagaagggtgataaatattaattgcgttatcatgtgttcttctgttccagttaagctgatgtaatattttgataaattttccatttatgaataaaactagaaaacgacttcaaaacaacggttaatagcggactcattcaaatacgtgataagaataagatagagtagaagaaagacagacattgatcgtgttgtctccacatagatagatagaatggcaattttcatagtccaagcaaatacaatatgctttgacaaatgagatcaggtgatattcattattcatgttgtgggtgtttgattctatgaatatgtactattagacttcttaatgcacaaaaaatgaaaaaggtgaataggatttgacaaaagtctacatttggacgtaagttttttttaaaatatttttaaaataagaagataagtagaaaaaaatgaaataaattttttcatgaattaaaataagtttttaattagttcatttatagatattatctcatcttttagagaaattatattaatatatttttaaaaattaactaataaaaaatttatttttgtctatgaaaaaattcatctcattttttttataagtatttctaaataaatttaccaaaacatctataataatagttactaattagattaatctctaggtatgttggtagtatttttttatagaaaagattttattaagaaaatgctatatagtatagcctgtaccattaatacaacactacaattagtacaagaaatctacaacaataataaatcaacataaagtagaaagtaattgggttgggtgtggacgtcgaataagacgtggttttggctaaaggttccacaaaccactattgtcagtgcaagtcacaagtgaaaaactagagaagacaatagtcgtacagttagatttcttttatttaattcttcacgaaagtgtcactacccactagtgaaatgattttcgtgtatatttttctttcattttaagctttgtgacactcaaacccacacgagtcatgttatagtgcacatctatctgatcgatatatgaaaaaacttggaagttatacagcataaacatatttttttttctgtattcggagtgaggaagtatcacgtggaagaaagattacaacatggtacagtaaaatccaagaattaataaatggaagagtctatcacttttcaaagtactagtaacctcttcctaccccggcccggataaggaaaaaagacactaatttgatgttgattcttggcacgtatgtttgcatcgaattgcaacaactatgctaatttttctatgatctcaatgttccttcacacttatatgcctagtgattgagatttctggggtattcacaatcagttccaggaacccattttgcacgttatgacaccaaaagcacgtattcacatgctccaacgagaaaactgcctaggtgcatgtgcagccacacccatagcaatattttttctatttttatcaatcctataattttcagacaattaaaattaggcacacgccatatattccatttactctcttttcttttacatcacattaattattgcatccgtaattttctcttttcagatcatttcactaagataatgatatgttagtagatacaacttgtataaaataaaattttgaagaatatttttttcaagtttgtgattaaagattttaataatttaatgttacacgatttgataacgatataaaaagttaatagtatgttgaaattaaattatttttttacgtatctttcaaatgatctttttaagagaaacttattgttactagaaaatgttttatttaaataacttttaatcccttaaaaattgtaatttttattatatatctcttacttaaattttttcctacatatacctgtataaaatatattttttgtctacaataaattttccatttattgttttctcttgaaccttttaaatatcaagattttttaaattttattattttaaataattaaataaaataatgatatttaaaatcaataaatgatatacttgtaatatttaaaagaatcaaacaaaaaaactatatacctaatagaaaaaaccaacaaaaaataataataaaggaatcgtttactaaaaatacgtttttattgagaaatcgtcttaaaaaattaccatgaggaactaagcaagaaaattacacatttttggggccctccctttggcctctacttggcacattattagctacactttttaaaatacaaattcaaacccgataaaaaggggtcgataatgatctcattctcctgaatcactattatttactttgtcgacaaattctttagcattagttttcattatttaagtgacaaaggtggatttgtctttctccatgttccgttcaatacatgacgactggttcaaaactctgacagcggctagagagttttaccgctccaattttgtttttttggatcatgatttatcaaacaccatgtctttgacttttgctagttgcagccttgcgaggcaataagtaatatctgtgacacaatcacaagccaaggaagcaggaaccagagaggaaaatcctgtgatagcaataccagaccaaacatcatttattatttagacttaaatatgatttatctctacgataattattttgaatttctgataattttttatattaaatttaagataataatgatacatcaaaatttttattttaaatcactgcgtgacacaatctcaatagataatatatcaaaaagatttgtcatacaaaatgtaatgtctcatatatattgaattttaaaaattgtttctaaaattagtataaaaagacgcaaagcaacaaatttaggtgttaagattgatgcacaccagatacatcctaggtcaaataagtgtgtgttagaatagaaggttgcaaccgtaaagttgtagaagtatcatcacttttatttttattttcaagttaattttatcagttaaatttataaagttacacatatcacattttcaacttaaatccaaacacacagtaaaaaactcggaatgtaatcctaagtctcttcttttgaagtactgtatgtaatcctaactcggaggtgtaaatagtttgaaataatgctacccgtgatgagaaattcacttcaaataagtactatatgttttctttatttttaaaaaatggtgttccaaaataaaaattctacacaatctcttttattagaaacttcataattcattttaagggctgataaaatatgataaataataattagtgctttaataacattggtaaagaatttaaaatcaaaataggggcaaatacccatataatttcatatatctctttaaaatattccaattttaaaaaaaattggatagacaaaaaattatattatccataaattttcttataattttttatgatttatataataaatatttttaattttaatttcttaatcaacgagagaaactcagaatgctgatcaccgaaacccataaaatactaaggctttattgtgaataaaaccgcgttgttgggatcaacctttgacattaggcttccaagtctttctcattcgttgttactaataaagtcacaccaccttgcttttcaatccttctttcttccttctctccgtcaaaaacaattcccatctgccaaaaccaatgttttggcctcaaaactcataagttcacattttttttcttcatttccatttactttgccaatccctcatcttcattcattttcctcttgttttaagattttgcttctgattgattacctttgagataaacttgtgaactcagttctttctttgaccctcttggctaagctcagaaatttccataaagaaatagattttctccctgaaattctgttaggtgcttgatattggattttcattgggtccaagaaagaagatatcatcgttactatggttttgaaggtttctctcactgtggttctgcttgtgatatgctcctgtgttgtggaagccatttctaggaatcacaataatcacaatcacaacaatatcaacaaaaatggatcttctctggctgccataaagtttcctgatcatccaagtttcaatgatgtctcttcttctggggacaatgattgtagcttctcaaattctgagcaacttgggcattctgtacctaccaggacatcaggtgaagaaactgatgaagagagtgaggcttttccagcaccaaaaccacacgagaattcggtgaaactccacttgaaacacagatcagggagcaaaggtgctgagcctaaaaagtctgttattgattccacagtaagagatttcaccagaattcagaaccttcacagaagggtcatagaaaagaagaaccaaaacaccatttcaaggctgcagaggttacagaaggagcaaccaaagcagtccttcaagccagtggttgctccggccgcttcaccaacaagtccagtttccgggcagcttgtggcaaccttggaatcaggggtgagtcttggctctggtgagtacttcatggatgtgtttgtggggacaccccctaagcatttttctctgatacttgacactggtagtgaccttaattggattcaatgtgttccttgcattgcatgttttgagcaaagtgggccatattatgaccccaaagattctagttcttttaggaatataagctgtcatgatccccggtgccaattggtttcatccccggatccacctaatccttgcaaggctgagaatcagagttgtccctacttttattggtatggggatggttccaatacaactggggattttgcattggagactttcactgttaatctcaccactcttaatgggaagtcagagttgaagcatgtggagaatgtgatgtttggatgtggtcattggaatagaggcctgtttcatggtgcttctggtttgctaggattggggaaaggatcgttgtcatttgcttctcaaatgcaatctctctatggtcaatctttttcctattgtcttgtggataggaatagcaatgcaagtgttagcagcaagttgatttttggtgaggacaaggagctgctcagccaccccaatttgaatttcacttcttttggtggtgggacagatggttcagttgacacattttactatgtccagataaattctgttatggttgatgatgaggtgctgaagatacctgaggagacttggcatttgtcttcagaaggtgctggtggtaccataattgattctggcaccactttaacatattttgctgagcctgcttatgagattatccaggaggcttttgtgaggaaaattaagggctatgaacttgttgaaggccttcctcctctaaagccatgttacaatgtgtctggaattgaaaagatggagctacctgactttggaatcttgtttgctgatggagcagtgtggaattttccagtggagaattattttatccatattgatcctgatgttgtttgtttggctattttggggaatcctcgatctgccctttcaataattggaaactatcagcagcagaatttccacatactatatgatatgaagaaatccagacttggctatgcaccaatgaagtgtgctgatgtttaacatttttttggggttgaaacttgaaaggtgtatactgtatagtctcataattgtaaacacggtgagtcagggggtagattttttggttttcccttaggtagaaattggaaagtgttatacacaaaaaagaaataaataatttaaagttgattatagaactaggttccaggtaattacagaaaactggatcattacaaacataaacatttgttttgtacacattttaactgctcaattttgagcttatctcatttaattttaatatttgttctttctatatatgaatatatgatgttctctcttactatcattctggacatgttattgttttgtatattcattatcctcaaaggaaaactgctccgtatatatatatatatatatatatatatatatatatatgcacacacatacaagaaataaagaaacttggcaatgaagttctgtatcctgagtctccaagtcaagggggcaataacagttcgtggtttgctcattgttactatcctactttcttgtagactacatcctttaaaatttatacttatttcctcttttaaaatacttttaaatgaaaaataaatcaaatggcacatggacatggtcgtttcccatatgtcgcatcagtgtattattccatggcttttctgttaggatacactgccaactttataagaaaaaaaatgcatggaccaaagaataggtcaactctattgttggcctaggtactttgacattaatctaaagaataatactacctacacgtcaattttatatgataaattttgcagtttacaagaaaaggggaaaaaaagggaaaagtattagggatcacaatccttctgcccaaggatgtttctctgtaaccaaagaattaaataagacaagttatgtgataaagaaaaacaaattataagaagtgttataagcattttattgtaagtgtattattgctataatctagctctctcatttctttctttctttctttgtttttttctttttctaagagttatatttttttacccttaaaatagaggtttttttaaatctttttttgtttttttgtttttatattgtgagagacgtttttccttattatgccgttatagtaaatggtaatgtttataggaatttccaaagaggaaatagctccatcaatgtagattttataagtttctcattaaaaaaatataagttttatgtgtaagcttctgtttaataagatgagtacaaatacaattatttgactgtcgtcctttgctgaattggtctgtatacttaaacataaaatttgcagtttgcctccttccataaatgttctggtacattttattatttttcatagttctgcatcggcaaccagtatgaactatgaagcctatatttaagttttgagtgaataatcatcgtagactattatcatatatttattttcctccaaattccaagcaacaggagtacaggactattttgtaaaaagaaaaaaagtggtacaggactatagttattagtttattctttttttggtcatattcaaacctaaggttaagatatgaagtgggtattatttttcaactcgagagccgtgtttcaccctgagcatattttggtagagtgtgacatcaattaggtgaaagaattttcaatgaaaattttaataaatttaggcacattgttaatatagatttgcttacagagtgtggtcataatataactgtgtctgtgaccactgatggtgacaaaaaaaagtgagcgaatatattaagcgtgtgttagagtgagctatttgcgaaattattattttttagtgaagttgattttgtaaaactaattttaaataaaattaattttacaaaattattttgaaatgaaatgaaatttaaaatgatttgatttgttttttagtgttttaagtttaaaaataaattagtggtaaaacttaggttaaatttcttagttgattcttaaagacttcaactatttgggatttttaagtaggtctttatttttttttaaaaaaaactttggtcttaatcatgtaatattttttaactggattcttaatggtgaaattaatttttttttataaaaaagttaaccttgagagcctacttttttagttcaaagatttttttttttttttaagattacgtgaattgtgatacacttacaagttacaaccactcatacaactctctctatgacattattcattatatttttacaattctttttcttttgtactatttgttgaatgagttgttatacaaatattatttctcaatcaacaatagtggatggtggaggttggtgagtccacaatatagaggacggatttaaagtgtatagtttgcatatgctccggtgtgggtattgtggaccacggatttaaagtgtgttatttgcatattttaaataagtaataatatatgaacacttgtatatcaaataatttattaatatttttttcttttatattatatcatttgacatgtaaaagaaatgtcatatatacacttttttctcactaggaggtggcatataaatgttagatgtttatgaattattgtcatacttaaatagctctgcccaagaaattcaaaagaggcccaagtaatctatttttagacttgatatttttaaaaacctatcttgcaatttattattttatttaaaagcttattttatattaaaaaattataaactgtaaaaattaaaatcacgactactcaatacacaagacaaatgtgaaaataaataggttagactttataagataaaatatgaatctgacttgtctacatgangatgaagcacatgtttggtttggatgcgtttttaaagagatgattttttctataaatcctttatagaaaatttgtataagatacggttttatttttaaaataagctgaacttaaaatgacttccaagttttaattgccatagtacataaattaaaccgtcaatctcaataatatttgtaaatttaccttgtgaaaaaaatatattggattgattttagattgtaatttttttctctttaatttctaaggaaaatgatacatatgcccctggagaattaaaaaaaataattgaaatggctttatgaaagaaaagaaaaaattacaatctatatggatcgacaatccgtaagagtcatatggattggcaatccatatgactcatacggatcaacaatccataggaatcatatggagtgacaatccatatggctcatacggatcaacaatccgtaggagtcatatggattgtcaatccatatggctcatacggatcagcaatccgtaagagtcatatggattgacaatccatatgactcttacggatcatcaatccgtaggagtagttatatggattgacaatccatatgactcatacggatcagcaatccatatgactcatacggatcagcaatccgtaggagtcatatggattgtcaatccatatgactcatacggatcagcaatccgtaagagtcatatggattgacaatctatatgactcttacggatcatcaatccgtatgagtagttatatggattgtcaatccatatgactcatacggatcaacaatccgtatgactcatacggatcgaagatccgtaagaagtgaatggtgtatgtcggtatgcaacttacgaattttgagaaggacaaaattggtattacactgtgcatgctgggtgtattagaaaattgactggtgtagaaagttaaactctgtaaaaaatggtcaatctgagcctggggtttcagctgggcccaactaaggaaggcaccggcccattagggttttagtttgcatatatgatcctttgttgattagctcgtagcagtggaacaacagttgacggaagcaatcgaaatcggcggagatggttgccatgagggtgggtaatgttaatgttaatgttaatggtttttgtgtttgatttagtttgcagggtgagtttgtggaatttaacatgtgaatgtgattatggttgaagcagtttcaccagtaccaggtggtgggaagggctcttcctaccgaatccgatgagcatcctaagatctaccgcatgaaactctgggccaccaacgaggtccgtgccaaatccaagttctggtatgtttattgttcatctctatttcaaatgttgtttgttcgtattcgtactaattcaataataaaatgcagtcttttctatttctgatttattgttattattattgacaatgttaatgttaattgtttcaggtattttttgagaaaattgaagaaggttaagaaaagcaatggacaagtgctagccatcaatgaggtgtgcacttctcaattttactagtatgtttctgttcgtctcagaaatatcaattattgcactacaatgaattacttttgagcgctagttacttattaaaatgattttaatgaggctagatttctacgttgaagaattctagaggatttttctttttttttatataaatatgatactgctgggcttaacttgtgcattaaatttgttttagttatgtagacatttgaagaagggtagacataatgctacatatagagaccctgttaggtgtggatttgactacgggaagtcatttatgcttaacttacctatctgttgggtagatcacattatttctctttttctgtttttatttttattgactatggaagcaaatagttttcttgtcaatttttgccaccggtatgatggaatctagtggcgtaggtgtaggaatgtagataaatggagtgtactcgagtcatatggtgcattatttctgactaacaacctaacattagcacacaggaaatggtaaatgaggtgaaaggttttgaagtttggacatttggtgaattatgatcttatgaaagcccctttaggaaagaaatacttgaacaaatatttgtgttctaggttccaattgctgtcttattggacaatggacatggaggtttgagtgtttgtactgattgcagatttttgagaagaatcctaccaagattaagaattatggaatttggctgcgttatcagagccgcactggttatcacaatatgtacaaggaataccgggatactactctgaatggtgcggttgagcatatgtacactgaaatggcatctcgtcatagggtgaggcatccatgcatccagataattaagactgccaccatcccagctaagctgtgcaaaagggagagcaccaagcagttccacaattctaaaatcaagttcccattggtgttcaagaagattaggcctccaactaggaagctgaagacaacatacaaggcatccaggccaaacctgtttatgtgattcagttaatggaatttccctgcttgtttgattcattaagtataaataggaagagcttagaggtgatccatgcagtgacaaacttcgttgcctgcaacatagtttgcattctttcaagctctggagattttgtttttgaaagatggtgttttatttaattttatatttttgcagagtaatctattttactcattctgatgtattcgataaaggttgcttttgaatttagcgattacttctttgtttcgattctgggtttatcacttgttagttgatatattctctctgatttttggtaataaatattttagaccaagcatggctaataaaggacaaagctttaagtgtataaccttgagtgttttttgtgtttttaaaatcatattgaacttttatctcaaatttctacattgatttttaatgccagactatttatgttactgaagtgaaactgcagaaaacactaaaacaccttagcaactgcacctaagttttgtttgtcaataaactttatttctttggaagaaagacgaacaaggcatgtgttaattcagtcattgccgcttcggtttttattttaaacttgaagtagggcctcacttcattactatttattatctagcttattagggtagaagtaacaacatgaaatttaatgttaaattttaagtaaaataattaaaataaatgattaatattggattttaataaactattttgttaagttgtatgacagggattaacttatcttaaaagtaatcaatattgtaggctggataactattataaatttgttttaagattcttttacgtacatttacgcactcttcatctgtatcttatgattagtgtgtaacttcttttaaacgggtatactttgtgcttgtgcatactcctgattgatgacgaactacatcatggtgttagtcaaaattaaatcgttgcaatttgctcactggtgtaattaaaaaaagcttttgtattattagtttattaacttttgatttttgttaaatgacaaaaaaaaatcacttggtaacttgaactagacatgtttattacttgctgcacaggattatcctgtcgctcgtaagcgaatttacatttactaaggaacacaagttgaagaatgctataaaagtaataaactaagttagtaataataaaaataaaaaaaactgatataagcaacggtgaagggttaacatgagggaccacgtgcatctaccttttacggttcagcattagcacttgttaattattctattcccagtgtgcaagtgcagatataattttaactcacaatgacaaataggttatatgagttgtgactgtctatttactgtgttttccatatcccataatcatatttgtgacctaccattatcacgcagatgcaagcatgagataaaaatataggaaaaataatactgaaaaacttctaattgcaggtctggtaataattagagggacaacgttgaggttttggctcaaaattttaaattatgtgaaatgttaagaagtaatcacaaagaaagggctgatgattaatttccttgagatggattggtcgtttaaaatatggaaaaatattaacctcgaagctgcatgaaagaaatgtgatttgatacgaacaacaatgccatgtctaaaattgttaacattttttttttaagaaaggaaataacctttggtagagtttgaatttattcacttacttttaatgttttgttcaagcatgttataataatgtgtgttgagcagtgggaaacagaagatagtgtttaccagggaagtctaccacgacccactttgtcttttagaaccctccatcgaaatctgacatacttttttcttttttctgaaactccacattctccaccataaacacaaaaagcttgtggaagttaaccccacaaccacaagtttgaaatctcatttcattatatatcccaacaccccactttcataaccatcatttttcatgcaacaaccagtgctatttagtctattattctaacttcaaacagaaatatataattttgaaggttaaaactctatcttttttcggcttattgatgagttctctctttgcttcaagttggtctcattctctcctgatttggtctcaactttttagttgtgcaatctgagaagaaaggtaagagtgctatgaatcttcaaacacacatacacatatagagtcatgtatgttaccttagccagcttgagaagaaacatatacaaattccagaatgtcagtgtttctgccttgaagtcttattcactggcagtggagattgagttggccatcatcatattttcaataaaagaagaacgggagttcagcaaaaactcagtgctttcctctttcaattaagtattgtttttatcaagtttctccttgttagcgcatctcaagagcacaagaaagctaaaggcagacattcaagcaaaaaagaccataacatcaaggtatttcattcctgcatggcattctttctaattttgatcaattaagttggtattataattttgtatattcttctccttgtctacattgctattataatcctctattaagttttgtttgtgaagttacctttttattgtggttgttttatgtatgaagatgagttctagacttcagttcgaaatcacactagctacatgggtttctcttgtgggcttcaatggcgttcttaatgcctattggtatactagtcatcagactgtccaacagagaggggaatcaaagaagacttattattatattttatgttcatgcagtttcgcaggaaagtgtatctaaacctaaaaccgatcagttacattataattataaatttaaatcatagatcacaattttttttgggtatatttaattagtttcttttccctttacttggcaacccatatttgtacaattatttatatcgtttcagtttagtttagaagggtcagttgtcccattcattaacttctaatgatggtggaatggagataagaataacaagattccaattttacagttaatttgtttactaaagcttattagtcactacataaggtcaagtgaggggtattgcatctttgtctattggaaaggactataatgaatggtttgaagacaagaaagaatctttaagaaataatcttcttggttattggaagttccaagctttatttgtctcattttttaatagagcatgtgaaaagaactatgcaattatgctgttgtctgtatcattaatcaacttttagctcaacttataaaaaggccagaagtgaatgtacctctactattaacaaaagtaaataggtttattttaaagctttcttttcttgcattgatccttgccttttttattagttatatgcacgttttgtatttctgttcaaaagaagcttgccgtacttcttgccaatgcaggaacaatcatgtccataaaaaatttcaacaactccttcagcaataatcatcaaagattaggggtagcattatatggtattatctggctgcaagttctaattggtatttttcgaccacgaaggtgaaccaatgaattgcttgttattaagaaaatctatgcaatatattggattaggccatttagcatttgctaaataccaaacttagacaacgcagtcaaacttttcttctcttttaaatttataaagatttttcatgttctatgttcatattttctagagagccagctttattaacagctacagatttctgtttgcaaagcatgatgattagggtacaactgttttcttgttcttcgcaggggatccaaaaaaagaagtcttaggttctatgcacactggatagtgggaactgcagtgtcattactgggtgtgctgaatgtatttataggtttacaagcctaccaagaaaaaacatccaaaagcataacaacttggaatatatttttcaccgttcagatatctttgattgtgatattctaacttcttcaagaaaaaatgggtctacatacaaaaccaaggagtgttttgggacaactaactactgattcctacttgataagaaaaaaaagctagttcaaatgacaagaatgcaggcatgaaggctgagtcttgctaagaaagatgaatcaatgccttgccatggatgcaagtatttgaaacacataagaccacagatggacctcaattgctttccctaagataaaatatgtttgtgtgggtttcttttttcagagaagatacagtcattgaaaactttgtaatatcttcccgcgagatacattttttttgttgtattctcctaacaatcaattctgatatttttatcaaaccttgatgtggacgctggaatacttcatggagatagatcaatatattatccatgatgtttttttctatgtttgaggacattgtttgtcagtgtttataagcatttcaaaataaaaaaattagctaaccaaaggggtaagacagacacactatcactaacacaggagaaaacaaataataaggtaagaaattctattaatatcacattgatatatcacttaagtatcgctaactatggtatttcaaggaaaaagctgtacataaccggttaatatagctattcctagtattataaaaggtggaagaatcacaaatgctcctatggttgcaaagaaaactgaatcattcctttgagacacttcattgaggtaaccttgtctcttgatatttctcttttgtgagatggtcaagaacttcgcactcactttcttcaagtttttacctaggggtatggtgaaatcatcattcctttctccaaataactgcacgagctgctctcggattgtaagtttgcttccatcactttcataacctataaaccagaaaggttgaatctttgtaatccttttcccaatattgaaaaaaaaaaaaaaatacaagaaagaggttataaacagacatggctataaaatttctattctttcacataactcatgagacaaacatccatatcaggagtgattcataacatagagataaaaggcatgggtgaatttcaaaagttatgcaagatggggagaaatagacatatgatcataccaaaaatatggactttactcttttaaagtgagacattaagggtgcatttacaattgatttgaatccaaataacttgtaaacttgagccacttcaaactaaggataaatacatccttactttctcactctacattttttcttatcttagcggagtcaaatatttactcgattttcaaactttcatgctagctatttacctcccacacagctaccactgctaaagacattatctttgatgaacaaatcatattacaacacccaaattctaccatgaatttggtctatgctgagtagtactatgtgataccaccgttattgtttctactctaaatgtttatactatgcggccataagggggaaagataaggtaacatcaaaggcaagctctttcatagtatcattgaaattttaagatatggcagcaacatataatcttgtaacttgtgatttcaaaggcactactcttactttcaatttttttcccattaaaagtattaaaacaattacattctccagccatgtctatatcttcagcatatttcatttaactaacaagttaacaacaaaacagagaaggggtttctaacagtgataaaatggccttacagaaacagaagacaactaatctgtctcccctacacgtatcattgatttaaagaggacatgttagcttacgtaccactattaggtgagcttgtagatgtaagttgctccaaaagatccagctgtgcacgagaagaagataaagatcctaacaacacaaagtccccagaagccaagtcagacatgaatgagaacctcatattgtaaaatttagaagtatttggtagaaatttaaactggtaagataaaaaaaaaaaaaaattaagaaaatttgagacagtgaagaaatcaaacacatgactttcctacaaatatttcaagtttagtagaagttctgattcagttttccacttgtaaccatgtggatgcaacaaatattaaaatataactgacataatgtctcacttttctaaatatttgttgtctcccaatcatcaaagaaagaatatattttttaagatataaatcaacaaccaatatttgttgtattgggtcggagacatgcatatctttcaacccacatgatttagagactaatcaattactaaatcattggtccaaaaaaattttacacacagaattaatcaaatataaattcttccgttaaatgaattattctcttacaggtgaatgcaattttaccatacacatatggttaatcaacaaatatggaaattcatggttatccccataagcccatatttgattcaataataataataataataataataaagagtgggtaggaattgttagcgtatataccattagcagcagaagcatcttcctgtgtaactccagtgtcagtcccttgtgtttgagcacatgttgtgagtaaagaggaagaaggatggtagaatttgatgaggttgttgtgtttatgggtcagaaaagaaggcttggagtgaagagaagcagtgctgctgagattgatggccataaagtgaggttttttggagttagttgctaatgccattcattttgcagtttcaggtcggtattttaattggccaaaggcggcacttccctgccacaaatattatctgtggaggattctacttctatgtaggaccacaaaaaaatcattcttctaaatccccaccgttcaaaaatatttttctttcactaaataaagacacaatatgtaattttttattattggatcattcttataaaatttaatggaaaagtttgtttaaacttattttttttaaaaaaataagtgttcatttaaataaaataaacagttttataaattttagaaagatagaaatagatcaaaatttatctgaagaaaggtaattaaataatatttaataaaatatgatagaaattgattataccttagtatgaaatggaaaaaaattaataagtttagtagaggattaaatttattattatttttatgtttcaaataatttttttttagtcatcttttttttatctctttttttttataacctttttgttaaattcatatatcactaaccctaattaagtaaaaatacttgtgtgtatgttaattcattcatgagattctaaacaaaaattaaataaaaattattcattaatatgtattgataccaagtagaaataaaggcacatctctcaagtacaacacatctctcaagctgcaacagtcccaactggtattctaaggctttgtttgggagttaggaggagaagggaaggaaagagattcaagggaaagagaagggaaggaaagagaggaaaatgagggaagttcattcctccttgtttgtgagttaaaaatatattaagagaaggaaatggagaattaataagatattaaatatgaaaattatataatttaaatgtaaaaatatattaaaaatatattttaatatatttttgaacgtgtaactggggtaggatagtaattttaattacttttccttctaaaaatctccaaattgggagaactacaatttttaggctttggaggatttgagaggagttttaaaaattctcaaatcttttctctcaaaaattaaaactctcaaacaagaaaatgtttttacctaaacttttttcttccctcccttctcctctaaaattcctctctcaaacaaagtttaagttgtgtatcaccttttgtggggtatttattggatcggatttatctcatgaatcccaccatcaaagtcaaattaaatcaattaatttgaattttgaatttattatttttcaattcgaattaacttcaatcaattcaaaaaaaaaaacttttaaattaatatattttgagatagcctccttttaacaggtccatgtcaatcactcaaaacaccaccgatgatcagagagctgccttcaaatccttacctgcgttgagagacaacaaattaacacattatcataagctttcaatactaatttaagttaggacttgtttagataaacttgtttaaaagaatttttaaaagaaaaaaattagatcaattttttcataaataaaaataaattttttattaactaatttttagaaatttattaatataatttgtttaaaaaatgagatgaaatttacaaattaattaataaaatatttatgaataagttcattttattttttttctttattttttttcttctaataatacttctaaacaaatttacatctaaatatgtccttattttttatttcttatgaattagatctacaccggaatggtcgtccaatgacgcagcagcagctttggacggtgtcaagtctatttttaactgtttctctgtgtcatctattttttgcctttaattgtatttcgaaattagtgtgtgtatgagatgatatagtcatatagccccgtttatttaaatttaaatttatttgttaaaaaatattcttttaatataataactagttttctgtttcttttatgtttgtctaattcacctttatttttattaaaaaaaagtaaatttttgtttttttgataagtaaatcttatttatttcttaaaaaatcataggacagctatacattgacaattaagtgccattatcagacaaattaaaaatgaatatgatacatcttaaaaaatgaatttaatacaaattaatgagatcatattgcaaaccttaagtttggcagatcagcgattccaacttattttataaatttaaatttaaattctccaacttatttcgtcttatgtttatttttgccgttactttttattatgacacaggtgaacattgaactccctcagggccacaaactgaggtactcgaatttttatgattattggcaatttactgataaaaaatcttaacaaccatttcatttgccgtcattatttgacagcatagcagttacattacccataccttgataggatcttctagtttacataaaagataaaagacttcaattttaacaaaaaagagagattataagtcataacgtgaaataattacataaaatattgcgaagctgcaacaaacttgttgagaaaaataaattaatgaataattagataaagatagtttacgctatacatgaagatattggcagacatacgtaaggcatgatgaaataatcgtttacatgtctattaatcatggggagtatactacagcacttgtttctacattccatcaaaaggctttatttctctacattgaaaagtaacaacaaataatcaagaacttcgagattaaccaataacaataatttcagttaaaaaggaaaaaaaaaggacggaaaaagatgaatagaaatgaaaaaaagaaaaaaaatatattaaatcatttaaatgtttgtacctcatgcttgctagcagaagtagcaggcctcttcctcatgtttccacaagcaaactcttttcaataactttcaagaagcaatatgagaagtagcagatgtggtttaatttgctagactacaaattgtttactggatcatgactttgaggaagtctgatctttttcaatcaaagaagaacccaattgaagcataagaggataaacagggctaaactccttatctcctctgctcctcacatttgcagcataatcatcaagtgttgctttgatgcccttccagatttgatcctcccattgagaatctagccacagtgaatactgcaatggtgttagtttgttcctttgcagcggtgactgcaattcttcaggagcacgggtatacagatgatgaagtatgacatttggtggcagatcttgaagaagtggtgatgatgcaagctgggatgtttccaagaaaataagcggacgaaatgctctaagtgcacgatatggtgcacccagttgctcaacagggaacaaattttggcccacagctagctccaattcagccatatccctagccatcctcaacttgcctgattctgaaagtggtctcacaagagatgcatgtcggatgaagaatattagaacacgtgaagccatgctctggacaagcctggtgcatatgttctctgtaccaggagctgttgaattcctggaaggcaacaacctagaaagaaactcactgcgaaagtgaagaatacacttctggagttcctccatgtaaggtgatgcattgttgtccatagcagcatccattccgagcactccaaagttatgatcgtgtatttgtaatatgcaagactcaagacgatccagcattgcctggaataaagctgttacagaatcacaggcaacaccatatatggcacctaatgaagcagacaacacatctgcagcaatactgggcattcctttaagtatagatgatatctgtgtatgaacatcttgcagatgctgacacaatgtaaagttcttgagctgtgctggtgttgcaggaccatttacttgacgtgattcaggaccagtggatatctgtcataacaatgacattgaacaattaaaagattagaaactatgcttctatagtagtcatcctcccttcacttgaataaaatggactttgggattctatatattgcaaaactcatacacaaagaagaaggggaaacaaagcctttaggttccagagaaaacatacagcaacagcacttcaggtagtaattatctatctccagtcattatgtctcaccataccatgacaagtgacaacacttcaggtagtaatattggaaaaatattatataagtctagcaaaaatattaattactcaacacactgaaaaataaaatgagcacgcaagttaaatgattgaatggttgctgatcactacaatgtgatacagtacaagtccaataatacaatacacatatgaagtataaactcctcaatgaaagaacacgatgttctttatgcatgcagttaacaatgccataatttactgtgcagtcaacaaaactttccttcttctgtgaatccattctttccttgtaataaaaaattctttattccaaaaatataagtagttatataacagctaactttatagcctgccgtcctgaaaacccatgatctagatagcattgaattcatttctaagccaataaatgtagtgcttaaaacatctaataagcaacaatgccttagatacaataacgtcatttctgtttacctggtattcagctcgttctgcaagaagaattaaaaccttgccaatttcacgcaaaacaagaagagttaagcgtgcatccatctgaacagtttctatctcttcctgaatgcgtgatataattcttgatatttgttccttggagggaacactaccacgactggacattggaaatacagaattcactagatctgaaaggcgactcaagcaatgagccaaaaatgcattctggaatatttcgacagctgaaattatcttctcttttccagacgaattgatagctggtaacactcctttgacatctgtgtcatgtgaaattctttcaagtagattctctatcatggagtaaagctttggatatcccattgtaaaaatctctttaacaaaacttgatgcagtgaaagcagacttcatttggcttgcaaaagcctttgtaatggcctcccacactcgatctgttagcataggatcaccttcctatgccgcagcaggcaacatccaaaaatgagataaaaaaatccaatagaaaataagaaagtgtgaacaacagtagctagaatatgtatgatctgatgagtgttcctaggtaagaactcaatactgtaaagtataaatgaagacccaaatccctaggaaataggaagtccattgaatctgtttatttgcacattgttaagatcacaattttttccaaaatctaggataaaagaccttactaaaaaaatcaatgcaacttattcatacatctaatattgatcactttattacactctgaatacatacagaggagatgattttcaaaagattgcatattgatctcatcgcatccaaaatccatctagcggtgtttaatgcatcaaaagagaatggacaggcatggacttttacaatttctctactctgcatcctatacaactcttttgaagagagaaaggtctttgacagtataatgttgcataaagccggaagcctattaaaataattctacacaaaagagaaacaacaagcaattacccttgatctccttactccctcttcacttatgcataggtaatatagcatagcccaagtcaccccttggcatctgtttacagcataccagaggaaaagaagaccacaaaaaggaaagatttagaaggctggcaaatggtttgtattgcacagcaaatacttgattgatactaaaaaattgaaatattacagtcttgccttcttgtggtctctaacatttatagatctattaaaccagtgcaatagattcatagatcttgtcatgtcagtctcttcaaaaccaaatgaacacacacgtaccgaagctagcaattaatgactcaattcaaacttctaatataatcctcagattcttccatttgggaagagtgacacacaaaataatagctctcaatacactaataaaatggggtgtgaaaaactaaaaaaaaaacctgtttgtgctaacaatttccaaactaattactaatattcaaacaccaaagtttggctggccattttgcataataagctaaagctaagccacagggtattcgttacacaattatgtcggtaaagtaaaccaattctacgagagaagcacccccaatataatcacaacactatctatcatctacatatcaaactatggcgttcagaggacaaacaataatttctattgtcgtgtgatggacgcagaagagcatatatgaatccaaggcaagcaacaacataatttccttctgatgtaaacaaacaactaaaacaaaaacaatgagcctcacctgaatgacctcatcaagcaacaaaacatgtgtaaagggatcacgttttttagagagcaccctctgcaaatgccacacagcaacagcaatggaatgcaactgatccatgcaatttcccaacctatgccagagagcctctctagctttagcccctcctccaatgtggggcgtcccagagcccctaatcccaccaggaccgtacccacttccacccgaaatggtcttcatgtccaacgccacagtgacactcttagcacccaaacccttatacttattcaccacctgctccacagtgcccttcaattccccaagattgtagaaaacctgcaacccggtcccaacctctgcctggttcaacccttccattccgcgttccagaaccttcatcgcctcgctgcgaagcagatctcccgtttccctgacccaattgagctcttcgtcgacggcgtcgatgccggcgaggtcgtactcgtcgcagaggctgaggatctcgaagtggagctgggcggccttggcgagatcgagtttttcggggtcggcggcggccatgaggtcgcggagcttcttggaaaggcggagggcgcggatggagtgctggaggagctcggtggtgcggtggaggttggagagctgggcggttttggcggcgacggagcggtgagggtcggagagctcggagcggaggcggcggacggaggactggatcgacgagagcgcggatctgagggtggagagggcgtggtccgcgtggtggagggatgagagctgcgagaggaggtcgtggtgccgcgagaggacttccgagcggagctggttctccaggaggcggatcgcgtggtggagcttctccgcggtggaggccggggagccggaggagagcgcggcggaggagaaggaggtggaggagaaggaaggggagaggaaggcggagaagatgggatccgaggccagagagtctagggcggaggaggagggggtggtggcggtggcggcggcggaggaggggtttttgaaggtggagaggcgttgcaccggagatgcgccggttgagaccggcgtcctcgccgccgctggtgacgccattgtgattttcgttttggcgagcgagcgacgaaggtcgtttagtcttttagtacagacactaggataggatagttactctattacttttgttttatgtaacttcttgcttctgtaattgttttgtgtgattgtgtcttttttttttttataatttacttaccattcatgtgattttgattttgttaatgattttttttaaatttagtatcctcactttttaataacatggattttttttaagtgttgaagataagatgtttataattttttgatttttggataaacggataaagtgtgatattttgattagcaagcttttaagtttttttaagtttgctgttataaaaaaaagtgaaagtaagtttaaaatgatttaatgtctgattgaaattgggatagttgaaggtacttttagcgtgaacatgcttcctccaaagtaatactcatgtttttgtttgttttgactaataaattgttacttcttatgaaatgacacttcgaaaatcataaaacctaaaaataacgggttcacaaacatgttcttcgtatttttttgactccaatgtacctttagaggtatttgaacgatctttcagacagactaaaatatgtcttactcattgtatacattaaaatgcatatttttgtattgaattttgtaaaaatacttttgtaacattaaaccaaacatagcattaagaaattcagtttgcaaatttttgtaagaatatatataagaatttgatgactttaagtagagaaaaattaaatggctaacaaagatcacatctaaccttatgtaccaaaacccgttgctcctactcatctgtggatcacctaaccttttaacgtgtcaaagatcaaactttttacttgtgataacttctacaagtgacaagaatgcatctattgatctagaccattctaaacatgcatgaaattgcatcggcttttacggccttccacttttgccaatcctaaacaaattgaagactgaacttatgccaacaagacatgtagacacaccattatctatactttatctaatgaactctttgatgtctactatttctacaaagaactgaaaaagatttgggactccatgaccttgaaattcataactgaactaacatttcccccctcccccccgtaaaattggtagttccatactgtaatttcactcgaagtggtaatttctgcatttacaataatagaaaccagtgttctctcctcccagtaaaaaaaaaaaagaaagcagacagatcacctccagcatatttgttcaccaaacagtttctcgcactcttttatacaatgtatggaaggaaaaaagtacgaggaagagccaaaattgcaatgctagggaaaattgttctccagaattcatcttttatgctcttcaaattattcattccaacctataaacgtgaaaatatgtcaaactatatatataatatatgatcattcatcatctcatatcttccaatttggtgcagaaaattaagctttcaaattataaaacagagcaagatgggagtgtcaagaaggaattgacgctggttaagcaaaaagatgaaatctataatgtaataaagcataaaagatatcattgcaagcttaatttctatgcctattctattactaacgagaaacctggaactgtaaataaatataatttttttattcaggaatcaaagataatataaaaaaatttacaacaattctgacacctgttcaactaactaactgaattagaatctcttgacaaataaatacaattgaagcaaagtagtaatgataaaaaaaatgaatgaaataacaatatttggacaatttttttctataaatattttatttgagaagaaaataaaaaataaaaaaactttttttgtggtgaaattagctaaatcatattttctgacggaacaagccaaagggaggtggcggtggaaggtggtgatgattcagaagtggcagccacaacaaaggtagaagaaacagagggtggagacaaggactacagcctcagccgcgtagagtatcttgaaaacgacggtgtccatgatggtcgtttgaagatccagtcgtttccacctaaacggccacgacaccttcttcaaccacagtttgctcttcttgttcttcttcttctcctccatcaaacttagacacactctctattatgtaattttggacaaagagtatgagctgttgtttgtttatatatagaatattgagatagggtagcatgctttggatgcttcaaagacaaggatgtttgctggcccatgaataggttgaaccgttgaaccgtaaacaaatacttgcactttatttatgcactctacttttctcacatttctccattcctgctccttccgacactttgctctcactcattaaaaaattccaccaatcttgttcccgatttttagtttccgttataaattgtaatagtagataaccagatttaaaatttggtaatggttacaagaattgtaaaaatgtgagataatgataaattgatatagaaaaagtaaaaaatttaaatttaatttttgaatatatatatataaagtatgatagattagtcatgataatataataataaattaatttttaaattttataacttaatcttaaattaattttcaaaaatataatttattgttaaaatggttaatcatattttttcattcaaaaattaaatttacattttttatcttattaaaacaatttgttatcttcttatatttttaggtgtcaaaatgattatatcaaagatatgtgaaatttctatgagatatttatttacttttcattaaaaatgagtcttttttttagagtttaaaccctttaaatgaatcttaaagggatttgtttcttactaagtttggagatacctaaagttaaaaaaaaaatgaaaatattggtaaaaatagtggagttgttgattctggtgtaaagtttcatttcatgtgttgcatgtaaatttgtattggagagttgttgggggaatgagagcgcgtatgagatttaaaagcttgttaaagatgaagggacatataaaactcttcttttgatgaataacaaattctgtaacaatttgatttgatatagaataccatatatcatgtgccagaaatgagaaattcgactggcgtgttcgtctgattggttttatttttatttaaaaatcatttaaaataaacttagaaatatatttagttcagtttttatttaaaataaaattcaaatcaaattataaactaatattttgacggttgatttggtttgtgttttacaatttttactaaaatattatttcattaaaatttatatattcttttacatattttaaataaaattacattaaaaaattgttcataataatttacaaaacttattaatatgttaatcttttataataaaatctgtaaattttcatttattttaaactaaatatatcttaaaaaatattatgaaaaataaaataatatatattatataaattttatatatataacattacaaaatattataaaactcaagtaaaatataagtctataaatgttatagtttatatcgatttcaaaaatacaaactgtaaattaaatcgaaccaattagtttgagtaaaaaatcattcaagaaaatcaatttgttttgaatttttattttttgaactgttttcaatttttattttggatttgttttaatttgaacactcctaaaaaatcaatgttatacgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacattaaattatgtttgtaatattcctcttaaatgtttagttgctgaaaaaaatgattttaattttagttcctgcgatttttattttattttgatatttcattttatcgatatttatgtttgttgaaggattaatacaattatcatcatttatcaagatttagggtcaattattaaatcatatacacaaattttctctttattgtttttatattttaaattatattattattattctattaagtgatatgatgtgataattaaaaaaaatgtcatcgttttataaaatgaaagtagttaatggaaataattaaaagtgtacatgtacataaaattgtttaagacccagaaacatatttaaatattttcttacgtattaattatttacgtatgtatgcaaagaaaattgaaaggtaatattcccttacaaacaccaaaagtaatgtgatttgatctttccagcaaatctgacctttaatttgtagaatatatatgcctacatagtatatatatatatatatatatatatatactttttatgaatttatttatacacaaaatccctcaatccaatattttgtataattgattttgtttgtttataaataaagataactttgttactaatagaaaacatttttgcagagatatttattgttttttttggttgcgtggagcaacttgtttcccgcattgttgccgtgcactgcatgatgataagacttgacctggcttggtaacaagggtgtgtatataatataactagcaagtctcaaattaacaaaaaatcaacaagaaggggaaaaaaatgaggggagcgtttcattttttatcgattacaattctgatacgttgataaatataatggaggtgagaaaagaatatccggattgcattttatgcattaatgatcataagaaatatataagaaaactcatctgtatacatgaataaggcatttttggtttgttaaaattatatacatttgagtaatttatgaattctacatcataattaattgatgtgactgtggaagtaaatatgatgacttaatttaactttttgttatgtacaatagtaacacctatgtaaatgatggatgaatcattactaattattggttattaattgttggtgactgaattagtaaatgtgtgaatgaagattgattgtattaaaagagttgtttgttatgtaattttcaacagatttttttattaataatttttgaaagatttttctattagtaattttcgacggatggatatgtagaaaattatcgactaatttttccgtcaaaaaattatcaacgaatatattcatgaaaaattaccgaaggaataatttgtcaataatttcgaacataacttaccgacggatatatttgatccatcaaaaattttccactaactttaccgatagatatatctgttaaaaattttcgacagacaaaaaaaaatctatcagttaaatttgcaatgactgttttattaataaatttttgtccatcataaaatttgatattaccacgggttttggccgtcaagaaacatttttttttttgtagtggtatattttaaaacttccgacttttattaaaccattcttaaattaggaatacgtcctaatatgcataccttatttccttgttaaactgttcctacgttttactcaattattagaggttgatataatctgatattaatttataaaagacatgcctagaatatcgtaatattcaattgttattatgacgtgagtttgaataaaatcaacttataaaaaataaaattgaattaaatttttttatgaattaaaatcaatataatgatcatttaaatttattatataggagtatatttgtaagcatgctgcaagagttcatatcatatccaccgtaagagtttataaaaaagataaactattttcataatttttattaagctcttcagaattctctttattttataattatgaaaaaataagttactatattacaataaagataacaatgttagaaaatatccaattctgaaaaaaaaaaatccaaagatgtcttttcttgagaaaaatcttaaaatatctataaaatatcttcgagttttatttcaactgacttcggttcagtgccaaaagcttttattatctgttactcgtatatatattatcatgtcatcaaacaaaatattttgaaatagttgttattgaagagtttcttaacaaattaataatgcacaattaagtgaaatataaaagaaattaatgaaataatccatcaaaattgaatctgatatcttttattcatttcttctataaatttctcaatatatattaaattagctcaggaattggacagatttcgacactttgtgctttattccatctcataatttattttatttgcattgcaaaatggaattatgtactaattggaacatttttcttttgttctccgtgtaaagaacaataatatttctctagttattattaaatgtagtaatagatgacaatagtgttattttcattgaaacaagatcgtgtcaaatacatgttatgtgttggatatcctttctacctttgccaataactttatatatcaagtccttttttcttgtattttcagcaattttctcattgcagtgttgtcaaaagacaaattgacattatttcattgattccctaatttcactttggtatggtccctccaaaatgggtcaatcaagtggtcccagatactgatcatgtccacttatgcttagactttagctaatcgttgcttactgggtttctccaactacatatgtcaatttccaattgcataatggctagtcatcatcaacgaacacatttaattcaaattaatcgggattatggtaaatgaacccaaaaataaatcagaaaaaagaaaaatttcttggatttaatgactaactaccgtttcataaacgctataaaaatttaatatatcataaaacccttcaagctttattgtaccaaagccaatggagtgtggtgagaaattctcttattcagcttgtgctaaatatttttgatgaaccgagtagaattaaggacataaatgatactttcatttccttatttccaaaggttgacatggtgcatcggatgaaggatttcagactcattagtttatgcaatgtggtatataagattgtgactaaaatcattgccagtagattgcggaacttgatgtttcgtcttgttttgccatgccaaagtagttttgttccaaacaaacatgcctcaaataatatttttgtggcataagaggtgctccattcgatgagtcacaagaagggtaatgttgggtgggtaaacatcaagattgatcttgagaaagtctataatagacttgattgaagattcgtgaaggagaccttggaagatatccaaattcctgctaatatagtggatattatttggcactgcatatcgtccccaaagatgaaggtgttgtggaatggagaggttttggaggattttcaaccataaagagaggtattagacaagaggatgctttaccctcatatatttgtcttatgtatcgagcaacttttttcaacttgttaatgttgttgtggataatgaattttgggagcccattcaactttctagaggtggccgacaattgtctcatttgaattttgcagatgatattttatggtttgcaatgactacaaaggagcaggtggagactatcaagacaattctaaatttattctgtgagagctctggtcagaaggtcagcaatgagaagaccagagtatatttttcgaaaaatgttgcatggcaagcaaaggaggagattagccaattattagggtaccaaagtactgaagacttggggtaaatatctaggggttcctatccttcataatagagggaccactcagacataccaattcatcatagagaaagtcaccctaactagatctgtgcttcaagcactttcgtcgtatgtgatgcaatatgcctggctacctaagtctatttgagatgcagttgataagaaatgtcgtcagcttgtgtggggtgatattaatgaaagtaggagagtgcatatggcttcttggaaggatataggttgaagcgtaaaatatgttaaagcttggataagggaaagtactatacaatagtgtcaataaattcaaaaatccaaataccaaatctaaattaaactaacatgattaaaatatttttatgactttgaattttataagatagcaaataaaataatataaagagattttgaattataataagaataatcaggattatgactcattagtatcatttttttcctaatcctagtcctaatgaaatttatttcctagttaattatcaattttcaaaatcaactaaagtttatgatcagtgttagctctttgtcttaaatcaatacatcaatgatcatagatctatcaatttaagtcaaaggataaaatcaattttaaggatgatcaattaaaaataattaatccatcgtatattatccaaatagtttgatgatgcaatttggtgcaaaacattctctatataaatctactagttagatgcaaatgatcattactatgtaatcaattgagtattaggatgatcgattctaaataaatattaaaaaaaagaaaattaagtaacataaaataatgagtaatttcattaagaacaatgagagagatatatttggacaattacatcataaccttcatattaagaggattaacctatcatgatcagagcaaaactaataattctataaaaaagtaaacataaacatatcaatagaaaggaacgatgatcattatccattctagtgatttttttcacactcttcaattctcaaaagccctcaagattttctcaaatgcttaaaagttttaaaataaaacttaaaaataaaaagagaagcctcattctttatttataatattgtgtgaaatttttccttctatcttttcttaattaaaaaatattatcaaatatgatttaaattaattattacggtcatacaaaattatcatgaccgaatagcttcaaaaaattcatgatatttaacttttttataaaaactcttacacatctgtctttcacaaacttattctaaactgtgagttttatcaaataaattatatcaaaattcattaatatgacatgaacttacatcaaagtagaatcaaatccggatttatcatttaccaaccatgtattaatggtgagttgggcttaagagaaatgcgggtggtaaatcaaacttttatgctgaaaaatgaatggcatctagttgataataccgactctctttgggttcgcttggttcgatcaaagtataattgaggtcacctcaatattcctcgaattgatgcagggaaaaggggatcaaatctttggcaggggataaatgcggtttggccaaaagtggagaacaatcttcgtcggaaggtaaataatggcagaatggtgagattttggctggacctgtggattccaggtatggatagtattttttgtctattaatagtagtattgcggattcgaaaaatcaaaagatggtggctgactatgttggtgaggatggtacttggaattatcgcaggttgaatgccttgttacctatggatattgttcacaagattcgtgctgtgtgtgcctaatgttgattttggcaatgatgtggtggtctagaggggttttatggaaggaagtttatctaccaagaattcgtacttatctctgattccagaaggagatagtatgaatcaatggttgtataaggctatttggaggatgaaggtccctgagagggttcgaatgcacaaatggatggtgggcaggaatatgttgctaacaaatgtaaatcgtttcaaacgtcacatgtgtgactctaatctgtgtccagtttgcttggttcatccagaaacgattattcacttcctgagggactagctgtgggatcgtgttactggtaaccagattccaactgggtaacaattaggtatacaaattcaagttaggagaaaattgggaggttttgttctctctaactttggatacactattaataagtggatttttgaatctcagtggagccaagcgaactgtctgcatgaggagattaggcatcatgcagtaagtgattctggttatgcaacttgtggaggtagcaagatatatatgactatttcataaaggtagcaagatatatatgacatttggcacttttagaattttgttatgacgttttttcataagagtttcttcaacttttacattgattttataaaattatatttatcttctggggattatccataaaaaaattatagaatatttcaaagttttttatgaatacataaatcatataagtagtttcccagaattctctcatagaattattttgttaaaaatctaaaataatttatattgattcattttatttaattatataaataattaaatcgatatattttaaaataatatattacatatgcattttttttaatctcattcaaaattcaaaaagtaaaaatagaattgtaataaattggaaaaaaatgttttaaaacaatttaagagataaaataataaaataatgttttaattcttaaagataattaatagtgtgtatatatattttttatgtatgcgagttattttaattaaataactctatatgtgtaagtatgggacgaggtggatgttgtattcatacccacatttatttttattagattttacgagtaaatctttagtttcagactcatctctaagcgagcaaatcatgtggaaactattattttatttagattgttagttaattaattgaaccaaatgaaagcatgtattacgattaatcttgacccttatctaccatagcattgtaaatattagacatctttctgtagtaccgggctaattatttgagtgatatgtcccagatttttttttttcaagcacagaaacctcatgaccaaaagtagtaggattgattcgcatataaaaatatatctaattttttcccataaaatttttgaaataaaaaataaatattcaataacaacgcaagttggtcggttaattcaataataaatgagaaatgggaattaatactccattttttttgtaccattctaccaatttaattaaattatttacttgttcaatgtcaatgattgaattcttaagtttaccccaatcattttgaaattttcaattggataaaatatttcagtgttttttttttccttatcattatagacaatatcatctatattctctgaagtcaaaccagaaccttatttacgggtttttttttttcaatatcttcagctttcatatttgatcaggagacaatttcaatttatatttagcatatcttttacctattttatttcggagagaagtctatattttcccattgtggacgataagcatccaacacagaataaatggttttcgtgagatgggatttgtaacccaacccactaatacacaaagtggtatagaggcccaagtagaatagttcgaagacccatccaatttctcaatagagtgtggaatgtttgggaaaataggtgggttcaccttaatagaggtagaagtatgattccctatgtcagccatcagagtgaactctgaatgtgaagcagtacctgcaaacaacaaaaaaacgaaacatgtctatctggacataccggcagtcagcgagtctatgagtggtgttactagtcaaaaaagcaccagagatgtacacggttcgcaaaaaaaactgtcttccggggacagttggtccaccagacaggcacaattctcgaggagcctctgtcaagttctgaataccatgttaagaaagatagaacaaaggcatttggacttgaacagtgtgtgtcaaatacaccacgaatgatactttctatggacttattgtattgaatagacataaatgagaggatattcagtttcttaactttcctctaaatggagataataaaatgaatgcagaatatttgattctcaacactcaacaattcttaggattatcaagtcggttacatgattagatacacgaaaaaaatcgaaggagaatgacatccgtgcttcaaaacttgggtgatatgccccaaaacacttactactacgccaaaacatcaagttgtttaactaagatgagccgctagttatggttgttagtatcgcacgatacacgattcgaatcgcacgatttgatccgatacatgtcgaaaacgatacgaatcggaccactgaatcgttttgaagttgaatcgcaacattgaatcgtgaaatcgtacgattcaaaactgaatcgtgaatcgctctcaagtttccgattcaaattttacgtgagaagataaaaccgagaagaaagaaaaaacgattcaacttgaaaaaagagtcacggagttggaagataaaaccgaaaagaaaagaaagaaaaaagaaacagagaagttgcagagaagaagccaagacgcagtgatgcacatagaaagaagttgcagagaagaaacgcgacgcacaaagagttgaagacgaagtctctccgttgtcggcgtcacagcttggggccatcttcgtcgccggcgtcatcaaagcttgaggtcctcgctcatggtggtttgtggagacaaagtcacaaacaaagcactggaggcgtgaaggtgaggctgcggaagagaagaccgtggcttttatttgggaagggaagacaaagtgttatggggattaggattttttatttggaccccagattcgatttacttcctgcattccctttttttgcttactttactccttttggctatttttttttccttaaaaatttcacttgatattgtaattctagatactgatagtgatagttatgataatattagtcttgaaatttaattactatgagaataaatggttttatatttggttacttatatattttagtacttaattttttttttaatttggatttatatagtattatatatttttaagttatttttaatttgtttctgaatcttacgattcgatacgattcatgatacaaaaaaacagctgaacgattcatgatacgtattgcgattcaacatccttgtttgaacccaacccatagactctaatgtaccttcacgaccctttgaacacgtcactccactctctctattggagaaggtttgccctgaaccttaagatcatcagaaacaagtcgaacctggaattcaaacccatgttggctaactatgataccaaatggtataactaagaaagtccagtatactaagtttaagctattagtaacagcgtaactcttgacatataacatcctatataagatgcagactgttgcatatttaagtcaatttaatcatgggccaccatgctaacccaacatgcatcctctaggcaaatcattaggtttgttcaaaatttaactatttagcaaagggataacatacaccggttacagccacgtaggcctagtgctttgtattaagtggaaaaaatcagctagctgcagcagacaaaccaaaggaaaatcccctaatatcaaataaagctagatcactttatataacatccattgagtatacattgagtgagaaaccatccaataattctgagatgttcacctcaacaaattagcttcataaataaagcagatcaaccacaagaaagaatttgcagcatcaaaatagagcgaaagcaaacaccatatccatattggatcaagcatccaattgatagagagcacgtgaattcaaatataggatatagaacagtccaaagaacatttcataaaattgcaaatgcagaactgattacctgctaatattcatattataaattactattaaagcaaaatgtatgaaatacataagaaaattaaaaaaataataaaaacttccgaagaaactggatgtctacacagttctacttttggccatcagtgtatcatcaaagaggaaaatcaaactctaaaccaaaataatgcagcaaattatctactttgaaatactttaactgttcagacatcacacccaccctcaattcttactgcactgtgcatatcattaatattgcaccaatcgcataaaacagacattaaatccaaggatgaacaattcatccaggtcagaatccagttattaaaaagatattcatacttctcgtaataaaaacaatgatccagaagcaaattcccattctttgtaggtgctggtgataatcaagaaaaaaaaaagagagtataggatgcaaacacacaccaataagaaatagaagtaactatcttttctttatcaacatccttttatccaatttgcatcagaaatgaaaatactcatccttaccattcagttcatccaaagcaaggcaataacagttcattaataggtaacttggtactgtaaatattcgtcctcatttactatcatccctagtaattaatgacaagtagcagcatgcattgcccaagtcgagacacgccgctacaatggtggcataaaagatcacaaagccgcagctatgttggtactgtggtgcaacacaaatggagctccagcagaagctggatgccactccacacatcacacacacacacacacacacacacacacacactaatctatagtgcttacaattaactactttgctcacaccaccaagtcatggtgaaatgtaatcaaccatcataacaacagttaaaataattcccagcgacaaaacaataaagacactgaaacacaacaatcaatcttgttattgttcaaggagtgtcaatattaaacaagacagcaaagcaaaaaatcatgtctaacgataaatctacaacaagtttgcacaacagaattcaatcaaagcttactattttttcaaactaaaagccatatcaattctttctatcatgagcaaccaaaccaaccattaaatcaggtggctttggcaggatgattccccttggcctccccggaacaacagtcaccgtcatgctggtggtgatggtgatgatggtggtgctgcttccccttgagctgcttcctcatgtcataagcatcctccccgtcggcataatacttggcctccacatcatgaatcttgtatcccagggtcaccgtgtacaaattgaaggccgcacggttgctcttgcgcacgtgcagggacacgtactcggcaccaaacacctgaagcgatcaatcaaaattgaaattgaggggctaaaaacataatcggacgcggcgactaatttgtaatttgtaaatggaaagaaataatgggatgcctgttccatggcgttctgggcggcggtcatgagcttggtggcgaggccgagcttgcggtgagtgcggaggacggcgagggaggtgatgtgaccgtggcagtcggtggtctcttcctccatcttggcgaggacgtagccgacgatgcgggcgttgtagtcttcggcgacgtagaggaggtggggccaggagaggatgtgatagaggtagtacttcatctggtagttctccggcaggcagaacaggttgcacgcctgcatcgccagtaggtcattcaccgtcgccttccttatgcacaccattttttcccctttcctttcttctctctcacgattagggcaaacacgcaacgcaacacctaggagcagtgttttaagaactggggagccgattatcgaactgctagacttattaggttaatgggtcacgggtggaattggagttctactgggttaatggatcttgggtcaaattagagtctcacttctcgaatcaaattaggagttaggaccaacaagctaccacaacacttaggagtagtgttttaagaatcatatacaacatcgaatcggttgagataatgacttaatgagttattgatggaaatcgaagtctcattggattaatgaattattggtcgaatcgaattaggaccaagacacaatgcaatgcctaagagcagtgttttaagaactagacccatcatcctataagtgagacattggattaacgagtcattggtggaatcaatctcactaatcaaatcaatttgacttagtatatattaaaacaatataaaaataaataactaacataatttgattaattaatatgctaaatttaaaatgatcatcattataagttatttaatatctcaaataataaccaatatttcaagaataagtttcaaatacaaacaaatatcctatgtcttaaaaatatacttttttatatacataaaaaattattttttaatatagatccttagttattaattaaaataaaatattatgtattatttttaatttaactacatatttataaaactagtactttcaattattactttttataaaatatattttatagtactgaagattcaagtgaagattaattatagatttgtttttcctatttaattttactaattttactctataaatttcctttaattcctttgcaatgccataaaaacttgttttctgtttctgtactgctcctctgtattgtgtcacttcttggtgttgcatcgttatgaggtctcacacaaaaccctatgagagtctaccatcctagctttgttggtgttaatatattttttcttagttattcaattgatgttttattagtacgtaaaaatctcacctttaatggaccaagtttttttcttcaaaatacataaaattcttaaccaaattaaaagaaatatagtttaatcatataaaaataaaaaagtagtgtgtgaacaaaatttaaaccacataaagtctaaaaatagaaagagttgaagattgaacataaatagaaaagttataaaatcaaatagctagtttatcacatgtataaagagagagagagcaacacacttctatgaattcggaagtgagactactgaaaatagcattgtaagatagacttggtctggcaccataaatcattcttcttctccgtcaacattctatactctgacaaatctctcattgtcaatcaaacttcttctctctaactacttttgttctcttaccatgaataatttgaactttcattcttatctttcagtgtagctataacatgttcaacatccaatagatcttgccacggtaaattaatgttggtgtatataatttcatttacatttcttgttccattaatttctcttcaggaatcatcaccaagctatttatcaatcaaaatggaaaataggctagcactggaatacaatatacatgtagattttgttaattaattactagaaaaagtattaaattatataggtgtaggtgttaggtgtagcaattagaaacaatgtcatccattaataggcaaccttcgaagaaatctgcacgtagttctggaggatcaacatctcaagggtcacaaaactctagcgggccaagtgttaagtttgcgagaagaacttcaagtggaaggtatgtgagtctgtcaagggatgacattgatgcgtcctcagacttatcaggggattacatgaactacactgttcatatacctcctaccccagacaatcaacccatggactcatctgttgcaatgaaagctgaagaacaatatgtttctaattctttgtttaccgggggattcaacagtgtcactcgagcgcatctaatggataaggtcattgattctgaagtcactcatcctcaaatggcaggctccaaaggctctgtatgttcaatttgtgatggcagggtcatgagggatgagaggggacatgatgtcagtccctgtgagtgcaggtacgtgttattattaggtcctcataatcctaaagatattattatttaaggaattaaaaagataaaataataattgtaaaaataatatgaaagtgtaaaaaaattatataaaaaacataattttctgtctctgatcgaataagaatttttctctttttaacttcttaactaatgtctcaaggatacttgttagcatttgtcgtcttatcatcatttcttaattttgacattatttttatttgatttcttgttgagaaatgaagagaaactaactaagttacataataataattcaaatttaggtacaagatttgtagagattgctttatagatgcacaaaaagaatctggtatgtgtcccggttgcaaggagccatataaagtcggggaatatgaggaagacctcacagatcagtattctaacaatggggcattgccattaccagcgccagatggttccaaacgtaacgcaaacaacatgtcagttatgaagagaaatcaaaatggagaatttgaccataacaagtggttgtttgagactcaaggtacctacggagttggtaatgcatattggccccaagatgacatgtatggtgatgatagtgatgatgccctaaaggcaggaatgctggatcaagagaagccatggaagcctttgagccgggtaataccaattccatcaggcatcataagtccttacaggttaattaattatatcaatttatgctgcccatagtttgtaattataacgatgataataataaggtttaaatacatttttcctttatctaatttaacattttgttcattgttatttttgtattttttctattttagtctttgtaaaatgtgtttgttttattttttatctgtaaaatattttagatgacaatttttttattgtataattcaaaaaaatattttggtactgtttaaaatactgtatatttctttaaagatgaaaaatacatattattttacgactaaaatggaaaaattacaaaaaaaataatactaaattgcataaaaaaatgtatttaagtctaataataataattacttgaccaaatctatgtctatgtatctatttgcaggttacttatcttggtgcgacttatagtattgtgcttttttttacactggagagtggtaaatccaaataaagatgcagtatggttgtggcttatgtcaattacttgtgagatatggtttggcttctcatggattctagatcaaattccgaagctttgccctgtgaatcgttccactgaccttgaagtccttcatgaaaaatttgatagtccatccccatcaaatcccactgggcgatctgatctacccggtatggacatttttgtgtccactgctgatcccgagaaggagccacctctaaccactgccaataccattatttccatattagcagttgattaccctgttgaaaagcttgcatgctacgtttctgatgatggaggtgctctcttgacttttgaagccatggccgaggctgcaagttttgctgatttatgggttcccttttgccgaaaacacaacattgagccgaggaatccagacacatattttagcttgaaagttgatcctaccaagaacaaaagcaggacggattttgtcaaggacagaaggagagttaagagggagtatgatgagttcaaggtacgtataaatggccttccagattccatcaggagaagatctgatgcatttaatgctagagaggagatgaagatgatgaagcatatgaaagagagtggagctgatccttctgagtctgtcaaagtgttaaaggccacatggatggctgatggcactcactggcctggtacatgggccaatccttctggtgaacatgctaaaggtgaccatgctggaatacttcaggtgccaaacctacctagaaatttttatttttttaattttgataagagtttagcttagttgaactcagaaactcacatagaatcagagtagaccttacatattatttaccaacaaggtttatggacactgcaaatcgaactgatgtcttttttataaaatgagtatgttagttatcaactggaaccaacctttgttggcacctagctagcagtttctatttttatttttgaaaaaagtttagcagagttggatcacatagtattagagctaactcttaataaattatgcaacatgaaggttctcacattagcagtggcggagccagctttcacttgtaggtagtgccaaattttaagtagtgacaaattttatttttagatagtgccaaattttatttttaatcataattaattatataagtatatataattattataaaaaaaaaatttcaccacttaattactgcaaattttattttttaggtagtgccgaggccattgctggtctccatgtggctccgccactgcacattagtaacgaaaatcaaattcatgttctttgtgaaacatgaatatgttacttaattggatcaaccatgtcaactagctagaaatttgagtaaccaataaaataagagagatatgacgtgcatatccaaaaatcaatttaacttaaatatcgtatataataatagtattttaaaccaacttttttgcgttaatgaatgtaggtgatgctaaagccaccaagtcccgatccgttaattggaagtgcagatgaaaagattctagacttcacagaggtagatacacggttgccaatgtttgtatatgtttctcgggagaaacgaccaggttacgatcacaacaagaaagctggtgcgatgaatgcattagttcgagcatctgcagttttgtcgaacgggccattcattctcaaccttgactgtgaccattatgtctataactgcaaggcagtacgagaagggatgtgcttcatgatggacagaggtggcgaggacatatgctacatccagttcccacaaagattcgaaggcattgacccttcagatcgttatgccaaccacaacactgtgttctttgatggaaacatgcgagcccttgatggtcttcaaggtccaatgtacgtgggaactggatgcatgtttcgacgatttgctctatacggattcgaccctcccttcgtggacaaggacgccgacaagaaagatggtaaaaagattcaagggtccgaaacgccgtccatgaatgccagcgagtttgatccaaaccttgatgtgaacttactccccaagcgctttggaaattcaaccatgctggctgagagcatacccatcgcagagttccaaggacgtcctttagcagatcaccccgccatcaagtttggacgtccaatcggagttcttaggacccctcgcgagccactcgatgctactaccgtagccgaagccgtatctgtcatttcttgttggttcgtctttctctatattaattagaataattatcttgaacaagagttttctctttaacaaaagcactttattttctcaaagagttcttaaagatttttcttaatttcttgtctatgtataataggtacgaagacaagactgaatggggagacagagtgggatggatttacgggtctgtgacagaagatgtggttacaggataccgcatgcataaccgcggatggcgttcggtgtattgcataacgaagcgagatgcatttcgtggatcggcaccaattaatctcaccgatcgattgcaccaggtgctgagatgggccacaggctcagttgaaatattcttctctaagaacaacgcattcctagccagcaagcgcctccagcttctccagcgtctctcttacctcaacgttggcatctaccccttcacctccatcttccttgtcgtgtattgcttcctccccgcgctctctttgttctctggttccttcattgtcgaaaccctcagcattgccttcttaatctacttgctcatcatcaccgtatgcctggtgatgctggccattctggaggtgaagtggtctggtgtggagttagagcaatggtggagaaacgaacagttttggctcatttctggaaccagtgctcacttggctgctgtggtgcaaggactcctcaaggtgatggcagggattgagatctctttcacgctgacgtccaaatcggccggggaagatgaggatgacatgtttgcagatttgtatctagtcaagtggagctcactcatggttccgccaattgttattgctatgaccaacatcattgccattgcggttgcgttttccaggactatttacagtgccaatgcacaatggagcaagtttattggaggtgcattcttcagtttctgggtgcttgctcatttgtacccttttgcaaaagggttgatggggaggagaggcaagacacccactattgtgtttgtgtggtcaggtctcattgcaatcacactttctttgctttgggtttccattagcccaccccaaggtgctgaaggacaaggtgtagggggagattttcaatttccatgaaataacaatattattattgctaatgcaaggccaggtgggtgggtgtgactcatatgtttttagtttttctttttgtcttattattatatgtacgtaacagtcatgtatttttgtaaaccttcaattcacatgtcttaagtacataaataggacaagaaaaattagtcttagatcgaggttttttttcttttgaaaaaaaggtcaaagcaataataatactattaattagtttatacatgacgacatgattgatgttcataatgtgaatctgggttagttgttactgtctttgagcattccattttttccatcctcaaaagcattacatgtttatgttgtttgatttattcagtatatgtagtagatgaattgttaaacatcttagtaacttaaattaaagtgaactaaaggaaaaatgaagttcaaatgaatctgaaaacggactaattaaccttcaattgtttcactggtcaaattggtgccagaagaaaagggtttggcaagccttttacaggtacaattcataattcctcaaaatttaattgagcttaagtacttaaaaaaaatggtaatcaatttggcaaaatattataattaattgttcttactgtaatcttacaaattacgtgctgcttaagcaactaaacatcagtaaagtaatcaatttgtttgggtatttgttgtagctctaattgctaactttacttacagaaatgggctgccctaataagtggctcactgttatgggctatatttttgtttctgggtacatatgggctgtctaatttttgtatttacaggatgtaccaatcctatgaccagaaaagagaaagaaggaaaagaaaatagtggaaataaaaaatatcaattattttaatgtatggaaatttttacaaaaaataaaatgaattatgtagtatatgatacgcagagcattgagcatgtgctatgaaattttcaactagtatggatattttaacgatttacaaaagtctcaagatggtttaaattttcaatctttttgcccataaaaatctcaattaactagattgagccatctcttagaaccctttcagttggcttttcgtcttttttaaaattttacgaatacaaaatttatcacataattctcattgttacgtgtaggagaatgttaattaaaacactagtaaaaaaagtaaaagtgaaaaattgttattaaaagtaataaattgaagattattaacatatttatgcattaagttttaataatgcttttattttttttaattttttaattaatatctttaaactactcgtgaacggttcctaaattttatcaaagataacaaagaagaagcaagacaacaagcaaggtgtttcttttttttatatatcaattggaatcgattcagtgaatcagtctaaaacaaaaggataagtgtgacgaagtaccacaaacactagtttgtctgcttttgccaactctcacccaagtagctaccttctttgtctgattgataaaggagagggacgtgccaatgaaatcaatcgtatcgaactaaaatttggtgcaatcaattcaatgcattactagctatttcggaaacgcatattttgtaaaagagctcaaaaacaatgaagggaaatatgttaagagaagagataaagtttggttgatggtggttaccactttgagggatgatggctcacttgccacaaactttcgcatcaaacacatgggcgacaccttgatttttaaccattttgttcaaacatcataggctttggtgagtgccagataacggaggcaagtttttaaatatataaaacagttcaaaagtatgaattttatgttataatgcgtcatctcatttatttaatgagtttttttggtaatttatttatttatttaataagtttgaaaatacataagatgtcaatttaatttattaaagtctaaatcatattttttatccgtaaaaatcataaaaattaattatcaaaagatttacaataattcacacatcaaatttaacaaactaaggtaattaaactccattgacaaagcataaaacatatattagatgattgtgcataactttatttattattaatgaattttattttattttatttctaaaactaatattttgtcagatatctatccctgaagttgatatgagggggaaataggcatagtgctttaattgccgtttgtcaaatgaaaagtatagagtcaaaatctggatataaccaagttgactttatcttgcaggaagcaagtggagttgtataagttgcatatcagnnnnnnnnnnnnnnnnnnnnnnnnnnnnnngagtgctgaggacctgtagttttgtgtttagttttttcaaggaaaagctgatactagaacttataagagggaggatataagagaatgaaaaagaagccgataaaaaaaaaagagagagagagagaatgaaaaagaattgtagaaatttaatcccacactcaattcatattacctaactttataattgaccaacctttaattgctttattatgttgtatgggatatgagtacaagaaatgaatatcatatgtaaatacgatgttctttaatcataaaaaaaataggatatattactatatatatgttataatgtttaagttaaatgtaataatattttattaatttatctgttcttttttttttctttatattttcttaatttgttattcatatgcattttttttatcatcattgtattatttcttgcacaacttatgaggaaagtattgtgtagccaagtttaaataaatatgttataactcaagttatggtaatacatatgttttaatttatatagaattgttagaatataaaatattcaaattttgatacaaagtcactcgtataataatatattgatagttcatacgagtatgacatggataagtaatcaattttgaaatatggattactactagaaaataagcttttaaattggttgttttcgactttcaacatggatgttaacatcagttttcaaaaagtgatgttaagatacactatgcaacattaatttttaaaaaaatcgatgttgtataataagaaataaataaaagaatgtaaaatatacaaaaatcaatttcgatatttaaaaaaataatgttatgatacacttgacaatatcgattttcttaaaaattgatattgtgttgcacacgacaacattgattttcagaaaaattgatgttgttaagtttaccacaacattggttctctaaataatcgatgtggaaaaacactttctacatcagttctaccaaaaccaatgttgaatagtacttacagcatcgattttgttgaatagtacttataaaaacgatgtggaaaatgattggtcttgtcggtctttgcgaacttggagaagagaaagagtgaacaaagaagtaggggagcacaaagtagcaaagagtgagcgcgatgttattataaaaacatccagtcgcttgagttttaatttagtaaaaatccaacatcggttattaaaaaatcgatgttaacaaaaatcaattaacatcgattttttataaaatcggtgttaacattgctatgttaacatcaattttttaataactgatgttaatattgtcacgttaacatcaatttttgaaaaatctacgttaatattactacattaacatcgatttttgaaaaatcgatattaagagcgtcacgttaacatcggtttttttaaaaaccaatgttaacaaaaccaatttatttataaaaaaatgtcaccgcccttttgttaacatcgattttatcaaaaaatcgatgttaaagtaagaatattgaaagcattctttctaatgcatgcatcagattcaatctacaaagtggacattcgtacatattactgacttacttaaaacaaatattacaattttgaaaatttagaaaatagtttaatcttaaaataaaatttaaaaaattgcaaactacaattaacgaagcaaaaaattcaaagaaagaggcaggtttatacatggagtaatgtgatttacacatcaatttttttacaataaatacacaagataaagagagatgagaagtgaaaaacaaagtgtgtatatatatatgttagatatataatatgaccttgagaaataaaaaaaaaattaacacttccttattatttaagatttaagagagagaaagagatacaagaaataaaattattataagaataataagtaataaatcctccgcaaaacaaaacaacataaaagtagtattaatatcctagtaagcaataacactctctttatcaaaacatactaatcttgtgattggtgttctttaatgaatgaataagacacatgtaaaattcagtttattaattaatatttatgagtgcatatcatgaaccacacaagacaaggcaagacacacaaataagaacaaacgaatgaagaatatgcggggctcatcattccgtacctaccatgtggtcaggttctcttcatctctatttccatttccttctccttctttctttcctcttcaacatgtcataataaaattcccactcatactcttctttccaacacaaccaaataatctcttgcaccttaattctatcgcatactctgcctcttcattgcataggcacgtggacggccatgtcaatgaattcccacgtaaaattcgtgaaattccccacgttctgactaaggttttgaagtgtgtttgaagacaacactgcactgcactagtgttacgcacatatatagacaacaacacaaaagaaactttgtgtgtgtgtatatatatatatatattctaatggctggcaatgaatggattaatgggtaccttgaggctatactatccactggaactggggctggcaccgttgatgagcaaatgcaaaaagcagtggctccaccagaaagtgcacattttaatcccacaaagtactttgtggaagaagtggtgtccagtgttgacgagtctgaccttcaccgtacatggatcaaggtggttgccactcgtaacaccagggaacgcagctcaaggttggagaacatgtgctggcgaatttggcatcttgcccgcaagaagaaacaggtaacaatcacatttcatttagtgctaattgcctaaggttcgaaccctgcagggagagttgtttacatttagtgtctgacaatacttcaaacaacaaacaagattggttctgaagaagaatacttgttaggaatgaagaaaaaaataacactaaacatgacaataacacttgatttgaaagtagaattgatagtaatatatatgtacatgtgcacctaagttttttaatgtttatttgtttgattttgttgaatgctatgcaatagaatctcgagtggccaagcaaaatgttgtttggtttaaattgtaaattttcatttttgttgtatttgcttttttattcgatgaatttgggggaagtatatatacatatatacatatatacatatatacatatatatatatatatatatataccagagtgattgtgagtgaaattaatggggcactacttgtagttggaaggggaggagctgcagagattagcaaacagaagatgggagagagaacaaggacgcagggatgcaacagaggacctgtctgaagagttgtcagaaggggaaaaaggagatggcgttggggagatgatacaaattgagacatcaaagaaaaatttccagaggcagatttccaacttggaagtatggtctgatgacaaaaaggaaaagaaaatttacattgtcctcttaaggtatattaattcttcacttcctcacaatcattttgcattcaataaatatgtttagccaaatttcttgattgtgttttactaaggtatattgattgtttgactatgacccttgtcatttgacagtttgcatggtttggtgcgaggagaaaacatggagcttggtcgagattctgatactggtggacaggtattacacattgctacatgaataagctgtgacccttccatttagtgtgtgttttgatgccagttggtgagagaaattattagatggtctgagatgatcatggtcctattaatctttacgtatatgacaagtaatgaactgttattaattctttttcataaatgaaaaaattcgagtacatgtcacatagattagtcaaaactatggataggtgatagttctaaattatctaataatttctcggttgaagtagcttaaaaatacttatactctcaaaacaatcaatcttccttctcattttttgtcttggaattcaagaatatgaattggaattcccaaaaacatattcccaacttttatcaaacatagccttaattggtgttcaacaatgattcaatttcaaccaatgtattttttccagattaaatatgtggtagaacttgctcgtgcactagcaaaaatgccaggagtgtatagagtagacctcttcacacgccaaatctcatctcctgaaattgattggagctacggagaacctacagaaatgctaagtgcaggcacagatgaggatgatgataacattggggagagcagtggtgcatatatcataagaataccctttggtccacgtgaaaaatatctacagaaagaacttctttggccctatattcaggaatttgtagatggggctttagctcacattctcaatatgtcaaaagtattgggtgaacaagttagtggggggcaacctgtgtggccatacgttattcatggacattatgccgatgctggagatagtgctgctcttctttcaggtgccttgaatgtgccaatggtgctcactggccattcactaggaagaaacaagctagaacagcttcttaagcaagggcgtcaatcgaaggaggatatcaactcaacatataagataatgaggagaatagaagcagaagagctttccctagatgctgctgaacttgttatcactagcacaaggcaagaaattgatgagcaatggggactttatgatgggtttgatgtcaagcttgagaaagttttgcgagctcgagttagacgtggtgtcaattgtcatggccgattcatgccaaggatggcggtaagaatgcaactagggtcacacacactcaatgtttgaaagtcttttattacttaaaccttggtgatacttctttggaaaaggaaacaactatgtaccaactttttcaagggatggttatatcagttactttatttggtgttttcttatgcaccttagcatgtctcaaattctcaaatttaagataacgtgttgtatgaagtactaatggttcaaacttatgtaggttatcccgcctggtatggactttagcaatgttgtgacacaagaagatggccctgaagttgatggggagctcacacagcttactcgtggtgttgatgagtcttcaccaaaggctttacctacaatctggttagaagtgagtaactaacatgtctacatatcttggattacattgagttcttcataaatacttataggagaagaaaataagaaggtaaaatgaattaaacttctcctataagttaaaatcacttatgtattttaacttttttattgaagttttcttatgaaagaaatttgattcattttgcttattgttttcttccttagttcctttataattatccagagtcaatgactagccttgtcaagttgtaactgataactttgtgcaggtgatgcgtttcttcacaaatcctcataaacctatgatcttagccttgtcaaggccagatccgaaaaagaacataaccactttgttaaaagcctttggagaatgccgtcccttaagagaattagctaatcttgtaagttgacataattcaactgctcaatacttggtggaaacaatggttgagaacttgtaaaaaggactaatatgttttcaaacagacgcttataatgggaaacagggatgacatagatgaaatgtcctctggcaatgctagtgtgctcacaacagtgttgaaattgattgataagtatgacctgtacgggcaagtggcatacccaaaacatcacaaccaatctgatgttccagagatatacagatttgctgcaaaaacaaaggtataaaatttattgaagttttagtatatgttgagatctaacttcttatgtgataacaatgatggccagctaactagtttgaaatttctctcagggtgttttcataaatccggctttagtggaaccctttggccttactttaattgaggcaggtttttaactaactagccacttttgtaatattattcttattttgatgttgaagtgattattgaatgtgcttaaactcatgcaggcagctgcccatggacttccaatggtggccactaaaaatgggggacctgtggacattcatcgggtaatttaagaattaagtttagatagtcagttgcatgatgcatgctaggaagttcatgaattatttgtcaaatggcatcaaagcattggaaaaaaatttgtaaaccaagatttgaattcccactaggagagttactcacatttagtatctgacacggcctcaaatatgattgtctccgaaggaggaaaccaaaaaaaaatgcagtatgtagtgatttggatattaattgtacatcccatatttgctttttcttgttttatttattttggaaatcaaacaggatgaacacctaattaggtctagctccttttgaattgtgatgttaggccctgaacaatggtttgcttgtggatcctcatgatgacatagcaattgctgatgcattggtgaagttgttgtcagagaaaaacatgtggcatgagtgcaggaagaacggttggaagaacatacaccttttctcatggcctgaacactgtcgcacttacttgacccgggcggctgcctgtcggatgaggcatccacaatggcaaaccaacaatccagaggatgataaagctgttgaagaagaagagtctttcaacgattcgctcaaggacgaacacgacatgtcccttaggctctcaattgatggtgacttgactgcagcaagtggaggcactggtctagatatgcaagaccaagttaaacgcatcctaagcaagataaggaagacagattctggctcaaatggtaatggtggtggaaatgtcaatgtgctgcttgacaatgtaactagcactagcactaacactagcaaatatcctctattgaggagaaggcgtaggttgattgttatagcacttgatttgtatgacaataatggagctccagagaagaacatgattgagatagtgcaaaagataattaaagctgtgcaactagaccctcaaactgctagagttacagggattgctttatcaactgctatgccagtgatagaaacagtagagttccttacatcaggcaatgttcaagtgaatgagtttgatgctttaatttgcagtagtggaagtcaagtttactaccctggcatcaatacagaagaaggaaagcttttgcctgatccagattatgaggtacatattgactatcgttgggggtgtgaaggtcttaagaaaaccatttggaaacttatgaatggtgatgagaacagccccattgaggaagatctgaaatccagcaatgcacattgcatctcatacaaaataaaggatcttagtaaggtataaatcaacatgacatttaccattatattaagttacataatggctagctggaggcactaagagataaatgataatcatgtgtattaaattcatcaggcaaaaaaagttgatgagttgaggcagaagcttaggatgcgaggtctacgttgtcatcctatgtactgcagggggtcatctagaatgcatttaattcctcttcttgcatctagagcccaggcactcaggtaattaacacttcatccttaatttctaactaattttttcaatcaattcataatataaaacaagtaatattgagtacatgattgacttcacgttgagtcatccaaaatcacattaaaatagtatcaattaacatgcattttaagtaaatgctcatgtgttcaatttcacgttgaagaatttatagcatgttatgatctagttggtttaaaagttgcatcaatttcacacacacttaacataaaaagctaaaatagatagtttccaaatatcatgggcatgttctttgtgcgagttttctctcgaggaatgtcaaatcaaacgcaaaatgattctatggctagaaccgattttagttaaaagtaatcttatttcgaaattttatacaaaattttattactttgttttaagaataaaaacacccaaacttaaatatacgacttcaaaatcaattatatttagaatcaatttaatttgaaatcaatttttcaaacgttagcctaatcacaaactgaatgtttattatttgcttaaatatgttaattaggtatctctttgtacgttggagattgaacgttgcaaacatgtacgtcatccttggagaaaccggggacacggattatgaggagatgatttctggaactcacaagaccataatcatgaagggagtggtttctaagggttcagaagagttactaagaggtcctggaagctaccaaagagatgatattgtcccaaatgagagccctcttgttgcatccattactgaaacaacacatgaaaacattgctaatgctttgaagcaactttccaaatctggaggaatctgaagtgctacgtactatatattaagtgcattttctttgctctctcttctcaaaacaagtaataaatttatgagagtggtatgtgaatatcttcacatatgtggccactttaatatattacacacttcatcaatatctattatttttctgtattttttttttcttcttatcggatcatttcacttattatatatactcatatttatatttttttttctctttttctctctaggtgttaaccagaagattggtccaccaatcttttcctaaatttatttaccaccacagtcaaaaagaaaaaatgaattgatgtaaatgatctgttacctaatgcatatattaaatgtggctaaagtgtagctagatcatgcttttctttgttacaaattgtttttcttgatagagcttcaagaagttatatataatttctctaaaatacgaataaattgaactcgaaatttttgtgcaatcacccgagaattgagatagttaaattttactaaaatagtttcattaggacccgaagtattataagacaaaacccgccaattgtagcagcatccgttaaaatttgtccctttttatatatttacctcggtgttatgtgtgtttgagaaaacagtgaaatttatgtaatgagactttcctacttaatgaactgaatttttggtgattagagttcactccgtaatcctaatgtaataatgtgaagtatatatatatttttacatttggagatcaaatagaaacttgatgtaaatttgagagatataaaaatacttaatttttttaaaaaaaattatttaattaatttaatgtgtatattgttgacgtggatgtcattaagtagctacatcaacaatgcgtttcatatatgctattatctaagagggatgaaaaaatattttgcaaaattggagaattaactaaaataatatttaatatggaggaaaaaataaaatgatacaaatttgaggaaaaaaaacatatttaaatttttatatcacttgaactaatttacattttttatccgattaagaactatctatgcacgctgtattagaaaattcacaaatgttgctttcaaaaaaataatagtattgttagaattcaaattataacaatatattgatatattacatgtttggcccacaattaaactaattgaataatatatcttttcaattcacattgttaattataaaacctcatcattcccgctatcacagggagaaataattacttttatctttgtgaaattataatatttgattaaattgttactttatacatttggatattttatatttgttgactatatatttttaaattaatataaaaatgttgttccctatgaatttagacttgataaagttattattgaaatactaaatccctatatgcaagagttgagtacaccggaaaaaaaatgcaagagttgaaccatatatataaaataatatctttcaaatgtggataaaaaagaataccttgacaatagtttgagacaatagtaattttaaactcatataataatagataataaaaaaatagtaattctaatagtaattatttaaaaaaagtgaggaaaagtgcaaaggttttgtccggattatctttaataaaaaattatgcttcgaatcaaagtatctatttcttcctccattggtggctttttgtggccctctaaacgcatactcagaaaatgcacagttttaaactcaagctttcgattttctctcaggaaaggtctgaagatcaagcttagtcaaaacgtattgacaaaattacctctctcactatagtcacccgaattttatatcatgcggggcatagttaaacatcaaggcatgccattatctattaagggcaaaaaaacatacctttcagcaagttatattcgcctaatatatgtattttcaataagttggcaactaaaagcttctgactttcacacatttaatctaatctgaaagggaaatttagccattactggtagagaattaatttcttataataataataataataaattacatatgctattggttggtttacaaatttacataaaaaaaagtttttttttgttaaataaagtggatgatctttattttcttaaccatacttgactaaatttgagttgattaagaaataatgcaattttattacttcacttttttccctccaccatgtttttgtgtttatatttgctggttttttccccataattttaaaaaatgttatttcttactagatattcaaatgttgtaatttttccctctctctcaataatatgaaataattagtctaggattgaacatatcaagctctactaggaacaatatttttttttatatgtgatacatatagaataattcattcaataatttatacagtattaaaaatacaattttctttgaataatgatattttatttaatttaaaaattaatttctaagattctttttattattattttgattttaagattttctttccatcttggttttctatgatccgttcaaaacatagagttaattttgggatgttcaaaaaccaaaacccaaagcaaattgaaatggcatgtgaggggaagcatagtagcatggtgccaagtttcaagatttgcataagatttttccctttcacacaaataggatagtttggtgaacagacatgacatcagaggaagcctagatttggtgctcagctcgtctgttggattgaggttgactctctctcccctctctctcttcactttacctttcttccttactcattacaattttccattttttctttctttctttctttctaccagccatccataaacaccgtacatacctattcatttcacatttgctttccctttactgtttctctctctctctcgctctctctgtctctgctttccttcattgcaaaccaagcttcctttccagcttggtctggtcctgccctcagacacaacacaatacccaccaaccatttttaccacatttactctttctcttctctaattagtaaaatacaaccattctctctctgcctctttattttcccatcaaaataacatttttgtctggcattcccttccattttcttatattaatattttttacattttatttttttgtttaagtgtggcccacttgttacctactgttgtgccactacatcttttgcagcatctggattttgctgtagggtatgtgtgttgctcatcctcaggtattctttgcacattaagtctcttgtcggttcaaaatgaggtgtgaaacctgttgcttctttgggtagaggattcaggagtctagctaccttggatcaccacaaaggtaaatgctttgtctttctcaatcactttttggataatatacatttcactttctcttttgtttgcttggatcataagtgatgctttcctggtttcctttctttttttcattagaaattgttgtgcttatcaacatgcatcaggttattttactttcccaaatgaactgtgaattcattcatcatgcctttttgattgtgttggttttgaaactgctgaattatatatgctacttcttgtattaattggattatgttttattgtatgccattgccaataaagcctgagatgggagtctttcatcttcaaatttagcttacaggaaattttgtagtctgagattatcttaaattatgattaagatgcaattagtgatttgttaaactcttgctttggttgttgtttatggcattgttgcaagaactgaaatgttggctgtaaattagtatgttcagatgtgtgtttcgaagtcttgagtaaggggagtacttaacttgaatcctgtacttgagtgggaatgtcttggttctaccagctgaagaacttgtggggacgatattgattgactcggtgcaaccaattatgtcatccaacagttctttgaatatggaattgtcaaagaagacgtcatttttgggtttgaaacgatgggttttgattgggataggtgtcggtgcatttatagtgctgattttgtgtatattatcgatatgggcaatgtttcggagaaagtctaggagatctctggacaagtattctgtatcccaaataccaaatttctcaaaagatatcgatgttgacaaggttggggtgcaaagttctcatgttcaaccagaaaatgtggttattcctgttcatgacaaggcaagtgacaacaattcagataatgtatcagtttgtttgggaaatagcaaatctggtgatcctgataatatcagtcagtgcagctcaatttatcatcatgagagaggattgagttcaatgtcagccgaagaaggaagctctgggaatgttaagaagcaatctacgttgtcacatggagggctggtcactgcctctcctttagttggcttgccagaattttctcatcttgggtggggccactggtttacacttagagatctggaaatggcaaccaatcgtttctcaagtgagaacatcattggggagggtggatatgggattgtttacaggggcagactgattaatggaactgaggtggcagtgaagaagcttcttaacaacctgtaaggatatttatttatcattggtgtaccctttaatttttttttcttctgccactttctgacactacacataaacaatgacttctttttaatcttgttatgtaattgagttctgcattgaattcctaggggccaagctgagaaagaattcagggttgaagtggaggctataggccatgttagacataagcatcttgtacgccttcttggatattgtgtagaaggagttcataggtaaaaaaaaatctttgttttcctacattagtatccactacactttgtattatatttcacaaattcattctcaataatagtgccagctttgggtttatgatagtcatattctacttagtacaaaataggacataagcttttctctatgttatgtctctttatctgtcataatgaatgtgcttcctgattgatattcaggctgcttgtgtatgaatatgtgaacaatggtaacttagaacaatggttacatggagacatgcaccaatatgggacacttacctgggaggcccgcatgaaagttatacttggcactgccaaagcgtaagttcagggtgcaacttaaaatatataccatggtaatcatttgtatagtctggtgccaaatcactcggtataattatcttaaatctctcatctctgaattttgattgtaaaaatgtgttcctttaattaatgttattactattagtgttttatgcgtgtcaaaatatatcataaatgttattaaatgtatttatgtttcttgataatattatgttatagactttatattctcatatagtttgcagtatatttaagcccattaggtttctagtctaaacaacaatatgcactctgcccatgggaccactgactatcttaggccatatttggatttaaattactaacaatgggtggaatgtgatggaatgaaataaatttaccgttgcactgttttaatattttatgatggaatggaattgaattagaaaaactggttacacccagtacccccaaaatggggggaagaaaaggagcagttttgggtggaatggaatggattccatttcatttcactccattagttcaaacatagtcttagtgaacatgtgacctattgtagtttaaatattttacttcttaattagttacaaaattatttttatggaagattcaatgatggaccttgttctcccgattaaccctctattgtactgtgactggtggcaggcttgcttatttacatgaagcaatagaaccaaaagttatacaccgggatataaagtctagcaacatattgattgatgatgaattcaatgcaaaggtttctgattttggtttggccaaacttttggattcaggcgaaagtcacataaccactagagtaatgggaacgtttgggtatacagaaaatttattatctctttccttatttttttacttaaaggatttgtacacttaggaactcacttttgttttggatttcagttatgtggcgccagaatatgctaacagtggtttgttaaatgagaagagtgacatttacagctttggtgtcctcttgctggaagcagctactggaagggaccctgtagactatgcgcgtcctgctaatgaggtggctaatttttatgaactctgcctgcttgccagttctaaccatgctttccaccgtaagtgatcactgcccttcaaatagctgatgagatattgtttatcttcattatgacaggttaatctagttgaatggctcaaaacgatggtggggacacggagagctgaagaagtagtggactcaagccttgaagttaaaccaccactgcgtgctttgaagcgcactcttttggttgcacttaggtgcatagatcctgatgctgaaaagaggcccaaaatgagtcaagttgtgaggatgcttgaagctgacgaatatccacttcgagaggttcccttcaatatctcttcttctcatacataagttctactgattagttaataactttgatcttgagtcttatatcacaattttgcatattatttaccttgtgtgcattcttatcattattctccttcgtacatgtattggctaacctaccaggctaccaccaactagaaagaacaaaatattggatgaactcaggaaaaaaattgggggtaaaatatgtttctgtttcctacaaataataattgttggttttagtcctcataagtcataatatggcataaaggtcacattaatgaacattctaagatggcatgtgacatgacatattcagatgcatgttaagtcatcaataaatggtgatagagactattttcaaaacttttaacataaaaactaaaactaatattttttttttcaagaactacaaccaaaagtcgccatattaaacccaaaaatttgatattcttcaggctacacaatttctatttacttaattagcacctcagtatagctcaaaaacaaacagacaaacaaagcataatgttttgtgtttatcataacatattagtgggagtatgctgtttaattctacctacttagcattctgatgcattatattataaagagcatggtcctcttttgtatgcatgtttttgggtgcttatatactaaatattgaagtattatatgttgacaacaaaacactaaaacgtaagctagacaactgattgataataatcactttcaggatagaaggaaaagaaagagtggcactgccagcatggaaattgaaaccgtgaaggatatttctggtccatctgatgctgaaaagatgggaatttctgaaagccacgttgaaggataggattgacaaccccatgacttagcctgcatgtacaattcccgttatacacgttatatatagtaacttatctataccatattgaaatatctccaactttgtgaccttaagaaaattttgtttcatctgaggatagaatcagatcagagtgagcccgtttggataatgaaggttttgttttgttttgtttttgtttttaattgaatggttgccattgaagatttgatacactagctagccttgcaaagagggtagaatcagtatgggtgctgtgagtgttagtgttttacagatgctacggggcctatcttcttacatgattgttgattttctttcttaacttccttgactttattatatcctcacatagtcactcgctgctggagagtggcgatagtaaaaacgaatacttggcttcaatttccatgtcaagtgactatatttttcaagcatcttaaatgggagttccttatgagattcttagacttaagaatcagtttttatataatttcaccattagagtcaataattgtgattttgtatatggataattcatctatatcttgttcattctaacaatattttccttttgaaagagtaaataaacgtagtttttttagagagatatatttttagtgttttactaatctagtttaaggtatttaacatattgatacctaatgatttttagcaaagtggtgaaaatgtagaactcatgtaagaattctgtttttttttttttaaaaaaaaaattgtaacattaaaagaataatttcttgtgtgacttattaaaataatataaacatatgaaataacttgtgagatttgttttaagtttttaaagttttaagtgtgtttgtatatccgttaagttcaacataatgccaatccaaggcctaattgtgtaaaaggtctgttggacagcagtgtaagtgtgtaacaactttccaaacacagccttgcacattgaaaattttaaaacttatgtggtaatagggctgatataaattaagaagttaaatagcttgtggagatgttcttatgcagtattttggcttatttgtgttattttctcaacaattagattccttatcattactactgctgcttctctccccctccaaattattgggctttttacggttagatatagctaaggtttgtctctacagtcacttatgtgcttattatacgtgtagaagcaatgtccgtccccatggttcaaattccaacttgcacaaattatctgacaagaaatgggcattaatttctttcatttttaacagtatagttaattaagttttcatttcaagatggccagcaccgaatgatgcagtaccccaataatttgtaaaagtggatgctttccttcacagcacattgttggttcatgcactaaaattgtgaatggctaatctagttatggttatcttttgattcttttcaacataatttttgttccattccattgatgctagtgtcataaaggaatcttatctttcgcaaataaattaaattgtacaaacatttttgtggatcttagtgaaataatgagaagggaaaaacttttaaatttgcatgttatttcaatcctttgttgattctcttatttcacccaaacgaaaagagaatctaaacatgggagtttcttgaggaagcacttatttggcagacaggcaaacaaatgattcaagttgaaggcttcaaacggtggaagtggaatgcataattattcaatattctgataaagtagacctattttcacggactagaatctaggcttcttgataactatctttctcttctgctacgtacccctttacaagctccatggggaatggggcaagttggcccatatttgccacatcttttgacttctccttccttcctttcataaacgtgttatttactgccattaatggctttttgaccataaagggctaaaaaagatgaataattaccatatgttaaaattatttattatttaggagtaaggtatgacttctaaatcaggactcataccatctgtcacgacctttatattttttcgtttttttaaagtgaagtcctaattttatttacgactttaatgtgcatatttttttaggtttaaaagttgtaaatgtatttaagaatttaaaattgtaaatatatttacgactttcaaattacaatttttttattttttttatttttacgctcaaaagtataaatatatatacgactttaaagtcgtatatatatttaggactttaaagtcgtacttttttttctcccttttgaaccccgcacgactttaaagtcataactttaaagtcgtctacattaaatattactaaatgcaccccctgtttttaataagtttctcactaaaaattgaaattagctaattgcaccccatttttattaagtatactccaatcttttcttttaaatcttaaacttcaaatgataatatttttaaaatatacccaaataattacgacgattgtgttaaaaaaagtcataacaattatatttgtaaaaaatcattaacaaaatcaacatatttaattagtaaaatcaaaataaatatatgttatttcatattttacaagttaaaattattaccaaaatattttcatccaacaataaatctctacaaaattaattttaacattactacaaaaatttacaaaattaattaaaatattaaatgtaattcaaagtaattataacataaattattaaaatacttaataaaataacttaaaatatttacaaaatattaaatcgtattacaaaaaataaaattacttgcatttttaaacaataaaattaaacaacttttatctatttttaaaattaattaaaaaactcaagaccaataaaaaaaacttcacaatgaaacaaataaaaataataaataaaagtaattataaaatatttaatatatatccatatattttaatataaaattaaaaaaacaaaaataaacatatatatatacttaacgaaaaaatataatatatatatatatatatatatatatataaagctataaaaaagaaaaagaaaatagttaaactaatatgactttaaagtcgtaaaaaatatatatacaacttttaaacgtaaggaaaaaaaataaaaaaattcagtttaaaagtcatactatctggcacgacttacctccaaatgataaataattttaaagctactctcatatggtaattactgatttttttttttacctgtttatggtcaaaaagcctaaattaatacttagttcacatgtataattgtttttttgagttgattatgttaacctttttttatattagtatttattttattgaaaacttacaattaatggtcttttttttatttcaatatgttaacataggttttataaattaaatacatttactaatatacaagcaatgttaagtatgtttggaaacatggtagctaggaacagaagaaaaaaacgcatctatttttttaaagacgtggaagctatcagctactatttattaacttcagagataatatagaaatctacgaataattaacctgcatgtaagcaacacatgctaattgtacatacaattttcattagtaagactctgtctagtacatgtgaaatatttaagaaaagaagtgaaggggatagaaatgcaaagaagtgtacgacttccctcgattggtacacgtgaaatatacgagaaatattaaaaaaaaaaaaaagaaaaactattggtggagtccatagaccatagtcgttaacttccactcactacatagaagatttgagtgaaaaacttgagacaactattaatagatataaacaaaatgaaggtcatatataaaatgcaaaaaacttaaactacaatcctaactaccataactatttttaaaatattatctttttaaggtaataaaattcaaattatattattaaaaaatagaaacaggccacgtgtaagacaattgggtatgttgaagtttaagatttctcttatagtatgtttggatgaaaaattttaattggggaaaataattattaagagaatttaaaattctccccccctaaataatatgaaagtttaatcttttctataaaatatgaaaaaacttttttacttaactcaaaataaaaaatttaccttaattattagcttaaagtttgaattactcggaagaaattacgttttattattacgataatttaaatttaaaatattatcctcttaattactatattctgacttaactaatttaattaattttttatttatctaataaaattttaaatttctctagagtaattagttttcatttaattaaaaaagtagttaaaaaaaaagtccgtgcattgcactgataataaaactatcttcttttacaaaaactgaccctacagacctcatgtcttcttcctcttttactctagctttccatctcgtgttcttcctcacaagctccagtgttcgatctccagtgttcgatctccaacataatcaatcgtgtattcaacataacgtttatgttggccaacagtaaaaaaatacattttctttgtgtaagtgtaaaatgatatcttttagaaacacttaattatgtttttgatttaagtaagttattattttttaattttggtatttagaagttttttatttatttttaattcttagaagtttatgcttttttttattatttcagcccatttaagatttcaaaattttaattttcataagtttgcgcttagatagattaagattaatatatatatatatatatatatatataaactaaaaatgaataaaatattttacagtaaccaagattaaaaaaatgtaactttacaataattaaaaatgaacaatttttttacaaagactaaatttgaaaaagtataaacttacatagacaaaaaaatatttaaatttttaaaaattattaaatttcttttcttttcctactttcaggcctaacaactttatcttatttttactcaattttccttctatttttctcaaataaaacaactataattttgttataccctatttattatctatttctcttttcttttattatttacttgtttatactccctctatttcctttctctctatcaaatataaccgttttttacataattttatatatttattacaagcatactactgagtatttggacttctaaaatagagtagtataaatctatgctagtttccatattaacgagtataattatttcaaatgttgttagaagagtatgtaacatgatcacaacaaaaaattgttcgtgtgatcatgtccagtatcaacatttgggtgtatacaatcactctataattctttcctttccctcacttctcattaagcaaattaattttctatacatgagtaaccagatgtttcttataaattagcttgtttggaccctagttctaacatggaattaaaaaatgtaaatccaccttctgctactcttacttttgctttaacaagttggcaatattcaagtcacgttgattatgcaattggaatgtgatggaaaattgccgttttaaggcattgctttgaggttggaacttgcaagtcagacaaaacaagtctatttcaataagcaatagccacaagcatgtcactttttcaaccacggaatcgattcaaatatcaaaagtagagggactttgctagattctctagttctcctactcttttgccagatagatgcaacactacttcttctgtctgcatgtctaattccacgtcaactgataattttgatcattttttttcaaggctaatgttatataccataacaaatagttttaatattttataaatgaaagtattaaataaaaaataactctatatatttaatgttttaaaaatattactattcactaatattatttcgttggtatgatgaaattagactagattcttagttaaccaagacattgattttaaattttttgaatataaaaaatatgattggatatgaaacttcatttgaggtgatcgattcaacatttatgacatgataaaaaatccaatgtagaaataagtaagaagttttagtaggaaaataatataatttactcgagggattaaaattttatttttacaatgaattaattttaaaattttcacaatcatttataaattaaaaaactttaactgcattgtaaaatttacttggattttttaacatgttttgtattcataaaaagattaaaaataaaatcgtacatgagatactacttcaataatgaatttatttctacaaaataggataatttttactgtcccacattaatgaaacacttcccttattgtataaagatatatgccttgcatgtcactcaaacttttattgggcaacaactttgtttgtatccgatgactatgtgtagacaaatgaaaagccagtgttgtaaacaagttggacaaggacaactggtgcatttatatagctagactatcttttcattttttggggacgggttaaaaggggttaattttacaaacaaattataaaactatatctcttttgaaatattttatcatattgtggtagaaaacactggaaaactctaataaagtgtcaaataatattttagaagaaatattgatttatcaatgctatgtacttatgtagtgtccatgtgagacactacaataccagtatcattgttactattattgcagtgtcttatgtaatattaataaatcggaaaagtatatgtgacattgtttgattaaaatagagttttttagtattgattgtctcaatttggtgaaatatttcaaattatttaatactttatttgtaaattaaccctggttaatccgccttcatttttcaatagctaggcatcgtcaaagtgaactacaatttcaatttagtctctatatgttaataaattaaaaagagtccctcaaaataacttttgccttccacattcgtcttttattacaaataggtccctgaatacagtatctttaaaatgcaatttagtccttgcatataagtattaaataaaattgcattttaatgataacatatatcttaaatgtgtgagggagaaaaaatgtgaaagctataaagtacttttagggacttcttaatttatttgaatttagagattaacttaaaattatcacagactttgaggaactaaattcattatttaacattttcatatgaatgaattggtaacagtcgattctttttttttttttttcatcttagttttttatcttctctttccgaatgaatctttttatcgaaggatcataaaaaaatgggtccgatactattgttccgtaccattacggaagaagattctggtaaaatatgcacttcctcgaaatacttcgtacagtgcccaataagttattgggcattcttttaatggttttggtacctacgggtttattaactgtttgtgacatcatggaaaagattattgttaataacactttttaacaaattttttttatttattaaaacttattataaaatacaagatcaagaaaatttactaaataatgtatattatagaattttgtaatttttaataaatttctaataatgagagataacgtgttcaaaagaatgaattagaaaatgtgttgttcatatttttcttttggataaatttttttatcgataaatattatatgttaactgttaattttttgttagtgaaaagaatcaaatccacaacattttcttttctccattttccttttaccatcaagccaactttagaaaaattatcataaaaatagtgtaagaattctaatatcattgtgtgaacaaaatttatcttttctatttaaaagaaaaaaacatgtaagcatctatttccttgaaattttcatttgacaaaatttggtatggatccatgtatgatttttttttcttctttagtttctgcttttgaagataatcttgtctaaaacatattgagacgtatactaaatatgaatatatttttttaatggagatcaaaaccttattttgttacattgtgagtaattaatctctttcattagacttaatctaccttaatggtaatttcctatgtgtgtatagatagaatttaaccaatatttgttttgactagcttggttaagtgtgataagtttccatttttaaatttttaataaagtagtctcttgtttcttttattaaaatattttttttaaaagagctaaagtataatattgtaaattaactaaatatttcacataaaataataataaatgaatatatttttggatatgtatgtgttaaaattcttaaaaaaatattgtgtataatattctatttaactcgaacaaaatttattctaataaaagatacatataatttatactaaaaaaatgaagatatattagaataaataattgatcttgattttttaaagtagcaaatattttgatgttgagatggtaattttgtgttgactaatcgttgataaatttaggataaactaaaagcacacgagactgacaaactgataaggattcaaattttgtcgcgagaaaggtgaagcttattaaaaagcttctatggcggcagagcaaacgataaatcaataatggaggcactcaatgattcattcatggaattaattaagacgctttggatatggtacaaagtttgttaattagttccgttaattatggtaaaccgaatttatagccataatgatttggacttctgcgatctacaaaagttgtgataatgtttaacgtgggaataaaaataaatcagttttttcactttttatttgtctcgtgatcatttagaatttcttttatggaattttttttcctcattttttcaaagttatcaattatcgaaatgaaattaacagtaaattatatcattttttttttatatttttaatgtttatatattaaaatgttttaaaccttggagcagccctcagctatagtcagccccgttagctccacctgctttgactttgtatgccatataacacccccagtgtgtcaaatttcaaatcaacattctattgtattttaagttttttttttttaatgttcagtactttaagatattacttattagtaaagaaattaatgtatttttaattaaaatacaatagaaattaataagttctcatgtatattaaatatatggataaaaaagggaactttgaaaattatagtgtaaagttttgtacaatataaaaaaaatactatatggttacactaaaagattgctttttgagattactattttaaattttacaataatataattatacataactaattaagaaatgatatttactattaaaaataaattccatatataaaaattacccataactttattgaagcgttgtaagcatcatcaagactttgttgtcttgtcttttgaatacaaatttgtaataacaaaaaatgtcctttttaatttagggtgcatttttagaatacatgtacacaaataagataaaaatgattatagataataatatatctaatattaaatttttttatgttcaaataataaaacaataaacacaaattagaacaacatcgcagaaaaataatcaacaccgtaactcatctcaaaaagataagagcgagacaacttgctaggcaaatatgagtatgagaggactgaaattttaagcaacttgctttttcctttttaagtatgatttgatctacggaaaacatgcatttaggattttaggggcccggtgtttgaatagttacacaaaaaaaaaaaaaaattgcgtatttaatttttaagtagaaaataaataaataaactatgcccattatagtcatatactagtatacatttataagttagaaccagtagatgattttatggatatcacgtaccctagaacgtgcatttccattttccaaattccaaagcattatttttttcttataaaattctgaacttggatagctgtatggctagttggattatcattaattcatcgtaatcaattaaacaggatacaattaattgtgaaagtaattggtaaacgtcaaataattgtttaataatgaacatggaaaagttaagggtaactaaacctcattttatagtgtatgagatcagatgaaaagaagggaagagaagaaagagactgagaaacaatatgatgaaaaaggaataaagaaatagataaaaatgaagtagaaaaaagaaagttattttgcaaatgtcacagcattcaacagacattttaactacttatggttctttctaaaacctgacggcattaacttttaaacccatatggtctttgcaatatttattttagtccaatatatacataatttcagccaatatatttcaatatatacataatttcagcnnnnnnnnnnacataatttcagccaatatattttagtccaatatatacataatttcagccaatatatttcaatcacaaattcgagtttgtatctaaacatgacaacgggctaaacgaggatggacaggcagggccttcttaatcttcaatctcgactcttcaacatatctttatacgggttgaaatttattatttcatcctgtatttaataaaattatattaaaaatttgattttagaaaaaaataaattaattattacacatttatttttaactatttatatcaataaatttattgtaatacatttgtcaacaaaaatcgtcaacaaaagaatattaaattatgtaaaaattctaaaataaaattaacaagtaataaataaaattaagattaatacatttatcttccttgattctattgttttttaaggtaaacaaaatacaccaaatattaaataatataactcaaagtcatagaaacaaacccaatgttcattagttcaaattacaccaaattaaaaataattagaaaatgaaaacaatcttgatcatcaaaataaggaaaatttaaataaataatgtttttttaataaatattttgaaatttaggactgttttaaaactatttcgaaatttggagcagtcaaacacgtccaatttggacgtgtttcaatccgtcgctaattcgatctttaagtaggtcactaacacttttttacagaacaataaggttttttaaaattcatcgctaattcgatctctaacacttttaaaagaatattgtgattttttttaattgtgttgcgatcaaattagtgacagactgaaacacacccaaattagacatgtttaactgtcccaaatttcaaaatatttttaaaacagccataaatttcaaaatatttattaaaaaagaattatttttaataatttacctcaaaataaccaccaacttcaacaaacatcaacatttcttcctggacccgatatttacaaaatcaaacatcatatatttagattttctttcaaatcttaaaattgaacatcacattagtaaataagtataattattacttcactaatcaataataatatctactaatcttgcaaatgttgaggaatggtactgaccaaagatccacatatattttaaattttttgaaaagttagataagaataatgatattaaagttttttagaacaactaaaagtgaatataccttcatcatcaaattcattctcatcagtaaaagttgattcttcaattgctctagaatctacaaataataaataacaatttataagtttaaaaaatataaacaacgtgtgtgttgtaacttaggaatctaaacaagtgaacagaaaattgaaaatcctaaataaagtaataaaagagaattttaataatttcatcatcagggcatatatgactacgggtgagtagtgacattcaatctccgacctcgacctcaattaaaaagtcaaataattcccaaatccaaattcgtacccaatcaactcaagtatttcccataaaaatccaaataggttcaagcagatacccatgaatacagattttatttccatgcctacttatatcaaatttataggttggtcgtagatactcgtattagtataaagctcgtgaatcaatgataaaaaatataaagctcgtgaatcaagtttttttaaacaggaaaattaattcaatcgatcgtattagttttggaattctaaaatgataatgctcctgaatattgaaagtttagagcataaattttgcaacaatgacaaaacaaacaaatcgagaaacaagattcgagaagatgcctgcaacatcaatttcttaatcaagaagaaaaattgtctcattttcttgctttttttttcgttgtatatattttcttggtttatttgcgcttattttttaattattgtcttcgtattactttaattatcatatggctggcatggacggaagaggtacataccatttcgccatgttgataaagaaagagggttttaattagaatgtcatatttacacaataataagaatttgtatacttatcccaactctttttaaagagtatattaaaaaaaaaaacccttaacatagagagtgttaatatagcctattaactgtgctagctagtttaggtttaagtttaagtaaaatttcgaaaaaattgtccttttcagtgaatcatctgactaaattcaaataagttaaggtgaattataaataatgaaagtctaaatcaaatagaaaagacagtcttagtacaacctcgaaagtacacatgcacacaagttaaaactacactacaacataaatacagagaaaattaatattttaaaaaggagccaaaaaaattataatttatctaattattatgatattatgatctatattggtataatatttttttaaaaaaggaaaaaaatatgtaaattacaatttcaaagtgttcatttatgaatatggcacgacatgaatattattttaaattgtctaaatttcttaagtataacaaagaattttcatgatatgtttggatttttaaaatatacgaataacaattatggatgtactaaagggtaaaacgaatagaataaaattactttcctttgaaagactaataaggcaattaacaaaaggaaactcatttggaacagaattattgtacttattaattaatctattaaaaacttcagttcccactttcaccctaattttaatggcgaattaaaataggttatttgaaggaaagaatggagaaataaaacctccaattccttttctttcattcttttctatttttaaatcatctggggatctaataataagcaaaagaatgatatgataccattgcttcttcttttttaatataattaaataaaagagaccctgaattaatttctaaaaatttgtttattataattcttaaagcaaaatagatcattaattttaaataacttcatttcgaactagtagaacctgatatacaaatggtttagttggtaaagatttattgctaattaatttcagcttgcatttgaatcatctggagctatattgattcctccatttggtttcacgacaaaacagaaaaaagaagataataaataataaaacggtagcttaagatcatatcaatcttaaaagttaggtatttatccacaaccaaaagtatagttacatacgcaagcacatacactataactgaaacgtcgaaatatatatacggtcttaattccatgtacctatatagttcttcattaatccccccataatttgtaatatatataaaaactgtaaaatgattgacatatatatcaaattatcaatgcaaaaaaataaggaccataaataggaattaatcaatagctacgttaccgtcgtgttataatgaaaacttctatttctagtagcgtactccttgaccactcttttaactgtgttagctagtgatccaagaaaccttcactaagtagtcctatcaatatatgtacctttcactgagaaagatcaatcatatatggtgcgttaatcgtcttgtcaaaaccatctttctccactacatattcgcaacttgcaaagtactcaaatgcaaaacacaccgcccatctctgacatttttgacaaaatttaccaaactatatttaagaatattaatcaacatcagtttcatctgcagtaattctaaatactcatttaatgctcttagatccccggccattaccatatagagacctgtctttcatttccatacaaatctaggtacatatatatatgacttaaagagagaaggagctaattaaccaaggggaagctactgcttaattactacacatacttatatatagacaatgtgaaaatacactgcaagctccaccttatgctaatagaaatgggttaagtgcatgtttaattctgtttatcttgaaaagataattattttaaaaaaaatcctagaaatatatactactaaaaattaataaatcagtgatcaaatttagtgatagaaaattacttttccttcaccagttaatttcgggatcactaaattttagtaacggaattcttttaaaacatatatagatcattccgttactaattttaatttttctagtagtaacataaaatataaaaccattatttttcctagataaaataaatcaaaacatgcactaggtttttggtaagttcatggctcttgtttgccagggaatgatggtagtaggtcttgcaataaaccacagtcacgagggagttggaactgctgctgctgttgaggctggggatggagattatgggaaaggttttggtgaaacattggattttgttgatcattttggctataacttggaagcaactgagcaagaaaatcttggggtaagcttgacgccatataagaggaaccaaaaaaggaaggtgatgacaacatgcttgcagcactgccccttagtgttgctggacagtgatggttgtgttgcccttcatatgttgtgatcacgattgttgggtcctggaatgatctctccacccttttctttacaccgcacttctgactcgtgcatctataatagctcctgcattataaataaagaatcaatcttccattcatacgtaaaatgtgcaattaattgatgagaagtatataatttcttgatgaattaataatttcttggtattgttgaatatatatacgtaagtgtaatattatggtcatatttacaatatatatgtggtatgtctccaatttcatcattagatagtggataacaaaaacaagcctcaataagtacttataaataagctgttgcacaaccttagtatgacaagaatatgaatcattacatcgatatggcaacaaataaataaataaatagaagactttgtgtgtcaatatgtgatgattttggcacaccccaatagtccacaacccttcttaatcatttttttcggctgatacaaatacaagagccctcatcatttttgccttaaaaggttaatattaatgtacaagtaactagattagaaatttcgaaattggaaaaaataattaaccttgggtatggactattcttgaccgctttctgtccatattttctccatctgtatccatcttcaaggtgatcgatctcacttttagtcaagaaggcaaagcgaggttctcttggctttttctctttctttttgggtttgttcctgaaacgctccaaaacatcagtcaaattcaccgcaagatggcagataatactcaccaaaccgataacaattattttagggttaagtgcctataattgttcctcactctccaccattttagtcatacacacaaaaacctacacacactagatacagtattaagagagtagagacaagattgaccaaattcatttcataagagacactgaaagtcataaacaactgaaaagacacgaaatgatatatgggcatactataattgcattagtaaatactactaaatagtacattcaaagaagaaaattcaaaattctacataccctctagaaaataacagttaataattaataagataatcagatcctattcatgaattgttaaaagaagaaaaaagagaaagtctatgaggaaattaaaatcttcttgccctccattgatctataagaaatcacaaagaaagagggcaaaagaagaagagttttaatttaaacctactctttcttaggcttttcatctccttcttcacacccttttggctgcttatctttctggttcttggttgagtcttcttctatgattgcttcagcttcattggatgatgaagacacagatgaattaggtgttgattgttggttcccactgacccccacagactctcctcctgcactaggcttcttggggttttcatcaatattggaggagatcacttcagaagatgaacaaggcatgtcaaaggctcttgagagggtgttgtaatccatggaaccatgtaagcagtcagtgaaagtggtgtgatgatgagaagaacggttattatgatcatcaaacccttgatagtttaattgtgagccaattggtgctgagttgttgttgttgtccctaaagaatggaaagcttgatgatgagtggttgagttgctgatcatggtggtggttgtaatgaaagggatcataaaaacggtccttctcattctccatggaagagagaaactgaagagagggagaatgggagaaggagaaggagaaggttggaggaggaagggccagatcaaaaaataaaggtagctttgagaatgatatttcagctaagacttaaattcgatgtggttgcttgttatgggaaagtgagcttttggtttagaactttgtttttcttcttgcttttattcccttctacttttgcacctcactttagtgtttggagctaattggggagtgtttctctatcttaatctttctaaagtcagtgtgtggttcattttttttctaaagcaaatcaatttttcttctttcaaaataaataaaggaacaattgtttatatatacctgcttgtgcatgtggcgtgatttctcgatttaatagtaatacaccgtatattctcaaacaacatctaatcatattttacatatatcacttgtttacacacactttaatttgtgttgaaaaaaaaaaatcttgtatatcttttttttgtcttatgagaacgttaaagttgtcgtcgcatgactttaagcttaagagttcaaatcttaaaaatagtaagttgctttatttttttttctgttcatatattatgcaatttgacatattttaaagggtgtaaaaaagtatataaaataattaacatgaggcaaatattttaatcctcaaaaggcaatcgattcgagaattattagtcagttggttgaaagatttattacctatatagttgatagcgacttctcaattaattgaagcactcctttattaatttatttgatcgttttgaatctaatcaaaagagaaagaaaaataacaagttgaataatgcttgcatgctaagatgtttctctttttatataataaaagataattgatgttatataagaaggcaacaatgctatgtattttattagaaggtttttggcttgctttgtaatgtttaagaagaaaaattaataaaaacctcaacctcaaatttacattttgtgttcatttgagctccacgtatatggcttggtttggtaggatcttatatgatagcgtgattgattatccttctagctagtatgttgacaaggcacaataccttctagctagtatatattattacatttctaaatacaaataaataatctgtattattacataaacaaatgaatataaataatttgtattcatgtacattagcattactatcattgttggagatagtttttgatagagaagggaagtgtcatgggggggtcgtagtcacgttgttaacaagggagtggagttagtcaagaattccgactataagcattttgtttttgtaattttggaggtttattcttacacgtgtcatgcgattgggcaccggcatttgaccggagagtgacacgtacgagagactcgttcgctgctattgttgattgttcagctccaacgcaaattcttcggtatttaaaaagtaagaaaaaacaatacttctatattatatattaattaaatacatgaatccatttagatataataataaaaaataaaataaaaaacataatgtataaataatagtataaatttaataatgcggatttttattctttctataacaacaagaaggaaaaaaaaaaaaaaacttatgctgttcctcatcacgcctagcttagctatgtctatgactatggctatatatgtgttgctgagtgggttttcacgtcccattccttttttccctttctttctgcccgaagtttgtggcacgcatctggttccctttccctcccttatgccttatcatatgctcatgtgctcacactatcacattcacatcaaatcaaaagaggaaaataagatggtcaaatgtgatgcatatatccaacgccaacgccaaccccatttccccactcttccgtatttataaacttctcacttgtctcgtatagttgcatacactgtttttaattaactataagcaagagaataagtctaagcagatccaaacaaaccaatgtttatgtatgtgcaataggacttcatatacatgaagcatatcaatgtgtgtgtaagcattaaggttgttttattatgaacttttagactttagctccatatataaagtttcctgtcctcttttaattaattagatgtacaagtcaaaaaattcaatctaaagaatagatcgaggtaaagaggagatcaatctgttaatgaattattaattaacttcaggcgtctcataagacgaatcaaagtctaccattagtcgaaataattagatccttactatgttatttaggtcatctctttatatgttgttattcattcacactcttccataactcaattagcacttagataataatatattgccccttcaagtgtctcctaacccgaatttacgatggaaaagatatctagcatcgaatgatttctaggatatatgataaaatagtagaaaacgcctttaatttaattttagtctgagatcttttgtacatggctacctttttttatttccttttcctttttcaattcagaaattaaagactttttttccccacttcagtgtagactagctaggagactctaaaatagcaattttttagataataatatatattgacaatctgcaccatataaaatatagactgtaaagtttattatcaagcctatattggtgcacttcttattttgtcttgtctttataaagtagctaggcagtgtattgatgtcaaaaggactcactatttctttatttgcttaagttttttaagaaaatatataaataatttaatttatatctattgttagcgttaatttaaccaccacaccattcttttaattaatatatgtggtgattgggtaaaatcctattgtgtaaaaatatgttgcaatacatataacttaaactaaaaaaataaattattaattagattttgattatgatataatatttgaatataagttagttaatctgattaaaatatgatagactcatttaaaagcgaatatttttacaaaacaagaattcataactttatttgaagattaccatatacaatacttataactacttaaactgttaacaagtgacagtgtagcaaaatataatcggaaaaaaaaaatagcataacaaagttttagctttttacgggtaaagaagtgaaattcgatcgttgaatatataattaaactttctgacattcattccttcatgtatagtaagctgaaaacaaaaacctcgattgaatcctgggatgttcactaatgaccagaccctcaacttaaagctaaagctgtttgttacaaatttacaataatatttaattaatagcaaattaaacatgagagttgagacctctttttaattgaaaaggtccccttttggagacaaaccggtgaatgatcccttaaaaataacagatagggttactgaataatatatatgtctgctccttctcaaagtaagacctcccattcccaattcccatatatctaatatctctgagaagaaaagttggtaaaccaaagacttttcttctgtttggtgggtgcaaaaatgcaaacccaacaataagagcacatcttaaatgtccccaccaaaccaagctgaaaggaacgtcgataaaaggaggatcaacatctttttattcttgtattcatttttaagtaattaggattcatgaatttattgattcattttatagtatcttatattaaaacgtggcacgcctaatataacttttatactttggctaatctacgtattagagtcatattatataggtacccatgtttttgctatccgtgtttcttaatccaaacataaggtttatgacaaaaatgaaaaaaaaaaaaaaaaacatagttcatgatgttatactatattttaattagtggtgtctaatataattctttaagaatatttgatgtgggagttttaaatatgtatatttagctgtcgatttcatttctcatcgagttttttagatttttataattaattaaacaaaaataaatgataaagtattttaaagtatacaatggtaagcgagatttttatttacgtgatagtatataggtagagtatgatgatggtaatttatatcattaggcgcaattttatcaattatcaataaatataaatttgacaaacaaatatatttttattagtctagtataaagtaatttttggtacaaagtagaatataaagtattcatatatattagaaataaagagaaaagaaaactaaaatagaggctgtagcatcattgctttgcctttcccttgacttaactccgcctgaccacggaccacaggattttattacaagctggaatttttagtttaactacctgagttaattaagctcaaataataatactacattagattttattaaatatatagttttaaattatcaataaattaattatatctgttcacttatgttaaaaaaataataataattaaagtgaatatttgttattatgattatatgatatttctttatttatggattatttaaataatcttacattataacaaagttaattttcttttaatatgtatgttgtgttgaccaaaaaaatcagaagaaacggatggaaagcaagatttcctgggttcatgattatatccttctttctctgacaactgaaaagtctttatgaggagcatgaaattgttgacatatttgaatgcttttgtgatggattagacttgctaacttcaatccgatcgacttgctggcattcatcccgtacaacgttaatttgaatgctaaaagcaataaaataaaataaaatagatcgagatgtgattctcttctctctagctatctagatttcttttttgaatgatctctatctagatttaaaatcttagttttcgatgaaaattgcaaaaatttcttgtcaacaataaggcattaggtttttaaaaaaaattatattttgtcgtaatcaggaatatgatggaggcgaacaaaaactttaaaatgagttaataacaaatgagactcatcaccaaaatttatttaatttagaaataacataaggaaagtgataatatcctatgatgtacgttttaaaagaatagttactcttaaccaaatgtgtaaaataattatgattttattttacttccttgtttttgtttgtaaaaagaatgaggaagaaactttatctatttattcaagaaaatggatgtatatttctagttaagaatctcgtatgatttttatttctttgaaaaggaattttttgttttgaaaataaaagggttgtaatgtctggagtccacgattgacgtggcgagtaataccataatgagtattccttgtcagccgtccatcttaatcattcttgggccacgagcatggatgttctccatatggccaatcctaggcagttaggccattatgcgagtatctgactgtcaaggtggttacaccattactgaagtggttgttatgctattgcaacaacctctcagttaataatctaggatttccatccatcattataaataatcaggtcttatattcactttaattaaactgtattaatatattactccttcaaacactcacttgaacgagcaaagaattctttttataagtacttccttattatttcttactttgaaagatactagttttagtcatttattcacttaaaattcagtatatacaaactttgagtgtaatcaaagtcaatatgaattcgagacttgatcttatcgtttaaatatttctttgacaaattggtaaacttttcaaggagttaataaatatatacttatatcctatatatcattgtataaggactttcatttgttgctgattgaggggtggtgcgatatgtcccaaggacatgataaaattgttatgcccaccttctaatagttcacaccaatgttctttacacttttaagggaaaatattcacacaaattacaacctcataagagtatgttggtcttccttgtgtttgtggtgttttgaatatgtcacctataatgattctaacactcaagttaatatgggttagaatcaagggacgagagataaggtgataacttatcttgcatagagtgatccaaggtatttgtagtatttttttaacttaacattaatgataaaatcgattaagcattgataatgacaatgattgaaatattcttggagagacattcatagttagttatgcagctattggtgtaggttgttaccctacatgtgtaagctcttattaagtgtgattgagctctcttggtaaatgatttcacctaatgtgccattttaaacatggactaggagttcaaaatatgaataaatgaagaaaataaaactttgtaataattgatgagaaatgatacttgtaaacaatttgtacaacaaatcttataataaaaagagagaaaaggagcaaagtgagaggagagataaaattttaaaatgtaataaatgatatgatagagagatataaactaaaatgatgtttataaattattttaaaaaatattgtgtatgtattgtactcataattgattgtataattattacctttcttatgatagatgattataaaaatatattattcataaaacaattagatagtaacaacacattttataaatttttgcatgaatcctatttttaataatttaaatcttaaaaaggagatttagtaaagagtaaaagattctccatataatcgttactcaagggaagtgattaagaaatatataagcaattttttttaattgaaatcatattaaaagtgtatttataacatttaatgttatattttttatttcattttttacgggacaatgattaataagatcatgataagaagaaaaaaagaagaataaaaaaaaagataaaaaaagaagtataagttttgtttaaaatattattgagatattcttattatgattttcattatgctcaattaattttttaataaaaaacttgtattatttatttaattcgttaatagtcccgaccctaacaataataacagaagtgttgaggtttattaacctcctatctaaaattcttagccaatgtaagagaaagataaattttgtgttgtgtctaacggtccaagtctaacgttgtggagcatagaagagaaagggatgatattgaactgtgttagagtgacagttatgcctatgatggctgttccttcatggagacccacgtgctgctgcgcttcttcttcttcttcttcttcttcagtttcaaccatcaacactgaccaacttcgttctcaacttgatcaccttcatgcagaggctgacgccacctgagccaagggtacctacttaacttacccatgtctcttattgttcttgttcattcttatttcattctgagttactttctctatctgaatcaaccgtgtttcctggacaacacccattacagccagtcccatgaatattatttaagtttaatttttattttttttacttttccactacaattctcaccaaaagaattgaattggactgctgtctctaaagggttcatttaaagattgaggattgaggcttatattgaaataattgtgtggtggttaacgcttaacagcaactaatgctagattgaggcttctgcgactgtcagaggctgcagagaagcttcaaaagcaagcggctataagcattcaaaaggggcaggaaaattatgcaagggaaatgctttttcagaggaagaaagtgttgcaggctttagacaagtctaaaacattgaattgctcgatgagctttcctccaagctaagtgaggtaaagtgtatatacattattgaattcatcagtactattgcagtatcttgtttgttgccagttttactttctattgtaattatgacaatatcaatacatttgagagagaacagctctgttagattcttaatgtaatgtatggccaatatgtttgaggaagggatttatttcaagtgtttgagaaaaaaagttgtgatttgtttaccagtagaggcatgaacacctgtagaagggactgcatatatccctctcaagctattgttttcctctctatagttttcatctggtttgtacaatgattgtctcaatttttctatcttaaatctgtatttcggtatgttccactgactgatggcataactgtgcctgtcaacctagactatcagtgttgaatatctcgtgtattttaaaagatatgtttgttttgcgtctatgaataatgtttattcccacccacactctgtatgctactgttgcttttactcaaaatgttcatattttagtaactgtataatgaaagaaacttattgtgggttcacgcaatatctttgaaagaaagtcagctaattggaaatgttactgtgaacattgaagacacaacagaagatgcttcaagtccagttcgaattattgctccaaaggaggaagttcaaaatgatgtcactaaggatgagtcagatcattatacagtggaatttggtagcgataattccaaagtcttttgaccttattctggaatcccttagtattttgaccttattctggaatcccttagtatcagcattccaaatgaagacaatatagcgagaaactagtcagaaatatcctcttaagaggacttcatggatcatataaatcaaaaactcagtgaaattgaagctgaactagtgactgttttgaatgtctcaaccttggtactggataatgaagagagaccaaaaaattctaggttgcaacaaacaattgaactccttgagagcatccatggcattagacagaggtataacacttcaatctattaaagcataattcttattgtctcctttgaagatttaactataaaaatcattttagagtaggtgctctctagtgattttgaattattgatatgaatatattcatattaagcgaaaataataaaaaaaaaagtaacgcaacactttttcaaatttccaaactcacagaattagaagtaccaaggaggccaaactgaggatctgatcaattttgttttgctcaactcatcttctgcttccaggtgagaactaacttcgtttgtttaaaaaaaaggtctgccacaattttcttgtatcccttaatcacttaatgtggaaacaggaaagacacatttgagatgctatattagtttattaaaatgaaaagaggtgttgatgttttgatttgccactattctttccaacacgcaatcatctgtttggtcatggaggagaaacagattgagaaatttgactaaggaataaggatagccgagtgaagttgcatgcccatgtccttaacttgcattccaaagtcttttgaccttattctgtctcaaaaatgtaagtagtagtgatattttttggaggattccatgagatgtcctttgtgtgtaaggtactgttgcatcaattactctgcaagttaccacctaaagttcttattgttgccatgattcatgagaaattagatattaaatcatccatctactttgtatcaagcaggctaaaaggcgtggcttttttttgtgtgtgtgagttttaaatatggcttccatgattcacgatttaatatatttgtttcatgcaataccataaactcccatcatgtgtttgagtttacacaatccatgcatgatgcgtacgtcatatgatatcaggagcttctgcaactgcggatgaaattattctgtttatggactcgtgtaaattgtgtttaacactatccatgataggtgttgtttagtgtttaactcatttattaatcactgactgactaaaccatttgtttcagtattatagttattattttagcagctgattttctaattccattatttgatgtatgctacaatcctaaattttcgtacactaattgttataaaaaggtggcattgtcactgcatgtatcaaactaattgttatagactcgtaaccaaaacttagcaatttgcagaaaaagcttcgtggaatgttgagaacaaaaaatgtattctttaactagactgcataaatttctgtgtgaactaatgtactatgagatgtctcatgcatgctattctaaacgtctgaattaaggcatgttcaactcaggcctccatgagtgaaagggttgaatttttattaacaattaaaaaggttaacctaaagttaacttctcttacaaatttacttgctcacaaacccacacgtggcagccatcacagagggagccattcagatggacagtcccttcttctccgagtctaaggtagctttatgcaaaaaacgttttcaaaatttattcagagtagagtaccactataatccaaattgtatattctttttacattgaggtatgtgatatgtgtctagcacatgatgtttccaagctcaattgaatcattaaatgcatcattttatatgataaatagcttccaattggtgtgaatgtaacttatgtgcttcaatgaggtattttggtctagattgaatgtttagcagttgattagctaagaattatgcagagcagaaggtatggcacgatccgcgccatctccgcgcgactagcgccgcaacctctggaacctggcgccatcagtgctaggcccgcgccatcagcgccaaagtttcttcagccagcgccatgagcgccattggcaccattccttctggatgttggcgccgtcagcgccaggacagcgccaggagcaccataggtcgcagagtctgcataatgagggcaaaacagagatttcactggctactctataaatactgaagcctcagcactgaagaaggagcttttgaacgaaattcatcaccaaaggaagaagaagaaggcttaggagctgagctagggtttggggttgaagggaagagggttcttcccttcctcttttttcttgaatatcagcaagcatgcttctttttgttgtaccaaggccatccatgtttaggtttggctagttttcttttgtagttggggccaaatgctcaatgtaactttcatttggattggattgaatgttattattcatttatgccaagttattttactgcactttgcttgaatatcttcttctcttctctagacttgatcaacctagttgagagctcagagctagggttcacaataggaatattggggctttagtcttggaactaagtgtgataacttgctttacatcacctaggaatagggatgtatgcttgcaatccttcctcctaatacatcacttaatgcttaacctaataaatgctactaaggaattagggtgttgaaaatggttaaagggttgagatcactacgggagtagggcttagctatcattgtgtgaagatgcatgaattgagtaactggtatagatgaatgtagtaaacaacccatgtaagagtgtcaggagtattgagtgtgggtctcgttaactacattagcttatgtttggtacaaccattatctattttgttataatactttgtgtttataattaggtttacatttactttgtccacacacatttctctcatatcttttgtcatccaacctatagattcaatttataatctaattggtcaaacaatcctcgtgggaacgataactctcttatcactttattacttgagcgaccggtgcacttgccgagtacccaacaagtttttttgcgtactcggcaagtgcaccggtcgctcaagtaataaagtgataagagagttatcgttcccacgaggattgtttgaccaattagattataaattgaatctataggttggatgacaaaagatatgagagaaatgtgtgtggacaaagtaaatgtaaacctaattataaacataaagtattataacaaaatagataatggttgtaccaaacgtaagctaatgtagttaacgacccacactcaatactcctgacacttttacatgggttgtttactacattcatctataccagttactcaattcatgcatcttcacacaatgatagctaagccctacgcccgtagtgatctcaacccttaaaccattttcaacaccctaattccttagtagcatttattaggttaagcattaagtgatgcattaggaaggattgcaagcatacatccctattcctaggtgatgtaaagcaagttaccacacttagttccaagactaaagcctcaatattcctattgtgaaccctagttttgagctctcaactaggttgatcaagtctagagaagagaagaagatattcaagcaaagtgcagtaaaataacttggcataaatgaataataacattcaatccaatctaaatgtaagttacattgagcatttggccccaactacaaaagaaaactagccaaaccaaaacatggatggccttggtacaacaaaaagaagcatgcttgctgatattcaagaaataagaggaagggaagagggaaccccaaaccctagctcagctcccaagccttcttcttcttcctttggtgatgaatttcgttcaaaagcccttcttcagtgctgaggcttcagtatttatagagtaaccagtgaaatctctattttgccctcattatgcagactctgcgacctgtggcgctcctggcgctgacgtcgccaacatccagaaggaatggcgccaacatgacgctcatggcgctggctgaagaaactgtggcgctgatggcgcgggcctggtgctgatggcgccaggttccagaggttgcggcgctggtcgtgcggagatggcatggatcgcgccataccttctgctctgcataattcttagctaatcacctgctaaacattcaatctagaccaaaatacctcattaaagcacataagttacattcacaccaattggaagctatttatcatataaaatgatgcatttaatgattcaattgagcttggaaacatcatgtgctaggcacatatcagtatgacatcacatcaagaaacaaatagaactagcactacgaagtacaaataataagggcacccatgatcttatgatcacaagtattggtgcaagtaatggccaatgcttctatagttctattcaccgaatatccgtatttcatgcatatgggcaagtgacagcaaatggttggtaatgatgtgcaatacatttataacatttgaccaaaaataaataaaaataaaaataaaggatgaaataacactaaggttatctttgtggcctgatgatggtctcaggttttagtagcagaaacagtcactctacaatagtggtagtctcgtatattgctcctgcccttttagaagagatgtttggatttattagacagtttccatgaggtcagcaagagtaatcttgccatacatgccatgttccaaggaatcaaattgtttgcttatttggagaatgtctatctcagtaatcttccccatttgcttaagcttgtatttgacaaagtcagacttgctgcaccaataaaactaaaatggttaacaaaaatgaatgaaagtaatataactcagtagtcagtattctctattgaactgaaaatttctgcatcatctttgcatgcggattgaggcctattggctcaaccaggtaatctattttgctacgttgccttctcatttgctcaaattagcacgtaaatttctatattgcaacctatatgtttcaaagacattgtaaaccaaccatagtggagttatgtcattatgcatcttgagaacccgaaccgttgacgcttgaactttcatgttccatcatcaatcatttagctacagatagttcctaaggtcaatctgttgttttggttaactccgacggaagagggtgaaatcatatggccatataagagagatgtgaaaggacttttaattaagaagaatcaaatttacagtagagcattgggacaagagtgaaagaggttttttatttatttatcctctttacaacatgataaattcttgatttaaaataaagtattccttctttaaggttggtctaagatgatgagggtcttttgatttctgtcccccatcatgcttcttttattgtgatttgtaaagctaaaacaactaggaaatgttcaacgaacctgatatactcaggggttcccctttgctaatttatcaacagatctaatttatcctacaatttcttattttctaagtgactaaaacaggctttagcgacgaacttctagtaatcttctgtttactcttgcttttgattaggccttgactccttatagctctctttgtaaccaatgcacagattctgctataatccatttctacaagcgaaaaaatgacaaggaaatatattatatgaatatgagactacaaacattcaggcatacctgattgatccatcattatcaaggtcggcagctgctaaatatgataatgttatcttcttctgaagaacccattgtgccatcttacgatttctcttgtgaatactatattcagtgaggtatataaaggccctggcaactgccggtgtgcttaccaaaagccatataattgcaaagcatcttccggttactgttctgagagaaaaatccccataaccaaccgttgtaacagaagtaatggagagataaatactgtcatcccaattcaggtcctcaactaagtgcactgtgactgttcctatagcaatgcagccaatcacaacagccaaagcaagacaaactttggttcttatcctcattcttcctttctcttcatcaaccatataagtcctgagaattatcttatatctattctcatcaatcatgctcaacaagaaggcctcttgtgtatcacaaatgtattcaaccaatctattgagcagaaaaccaagaaatccaaaacccaccaaaatgaaagcacatgtaaagatcttggtaaaagtggagtcaggaaagatatctccatatccaatagtgcagagagttaccatcgtaaagtacacagcatctacaggcctgaaagtggtattacccctgaaactcccactagtcatgtacactgtcaccccagttgccacatacaagaaaacaccaagaaaagatagcctcactattgaagttgatgacttgtgtggttcagagggctcttgaaaatccacccccatgtcagtgaataataaagatggtgcagagcgagagcgatggataatcttccctttcttgaaagccaagttggctatgaggtgcatagaagtcttggcttcatgggtgacatgatgagaactagattggaacagtgatggggcaagagcaagagcaagatcatggatagatagttccccaggtgatgatctgtttggtgagtctgcttctttcctagagcaagaactcaggagggattcctgcatggtgcattcaaattgtagttggggactagtgattacaagctagtatcacagcttctttaaactactagtcaaaccacagagaagattggaggatacatgtatattgtagctgagagtcataactcatatagcttccttgcacaaactttattctaataaggagagccagtgagtatttttaattttaatttaaagtgacgaattactaatattgaagtgtcttatattatatgccccaactagaaccgaatcactaaattctattttgatcccaactacgtggaacacgaaccccttgattgtatgccccaacatttggagtccaggactgagccatggcaagctagagtgtaccctaatagagaaaaaggaagttagttacatctacttttccttggtggtactgatactgcaatgccgtaaataattgattgattgattagataaattataaatgaggagaaaaaactgatccctgtaaagtacaaagtaatacaatatagctgtacagggaatgagttcgcccgattgcagaggatagctgcttataattaactgaattatcagaaacagttggatgcagttccagtaaggtggctgaaaatagacttccaacttccaagagcaacaaacaactcatgaaatatcgtgttgccatttcttttttaaactttttccgtgtgtcctaaaatagttccttcagtgataaaatcattattattgttaaactattgtggattcatttgtaatcatcttaatctaaccaccaaaaaattattacccagagatgtcaagagataaatcatttctcaagtcaaatcaaccttggaaaaaactattttttacatttcaacatcttttattggtaacacctaataggctagtgacagacagcaagataattttttgagccatatatccatagccctacaaaaatctagcgactgcacaactttgacatcatgaaacgatgatttgcaccatttggtagccgaactgctgcagtttgaggaacatccttgtgaggcaccgtttttcgtacttgtgcatgagtttctgcttcatgttgaaacatcctgactagctcttgaagctcttgttttctcagttcaacattttcttcaatgatgggttttttcaggccaagataaagcaatccaattccaattagcacgacccctagaacaaagaggatcacagtgaatagaagaaaggcaaaaggagttcctgaagatcctggtattccctccacatttatgccaaatagtccagtgatgatggaaagaacaaggccacaacccccaaatattcccaagttatgggtgactgtgaggcttctgtcctaaaataagtaggaagagtgtgattattcaacataataaactcccctatactctctattttctatatatcatcaatgtcaatagcacctttaatccaagttaattaggattggtggtagatgaactcaataatagatacgagaaggttggaaaaaaaggaaaataagataaaagaaaagaagggagaaagatgaagaggaaaaagactaaaaaatgattatctagaacatagaaataacaacagaactaactctctctattttctatatttaaataaaaataaaatgaaaaactggattgacaccaacacgcacatgaatatatgtcaagactgtttctatgtagaattatacaatttcatcaagtatcatgtatatattttggctaactgatgtgtgtacgcgcacagacactatccgagtgtactactacaatttttaatttgcattatgaatgcaaaagtgatataaaaggcaattaataaatatattacaagaattactttttttcttgattaaaaaattagagtaaatccttattttagtcctccaaagataaagatgccaatcctagtgcattatcattccttattggatacaaattatcatgcaccagtaataatgccagataaatcttttgcacacttatatagctactgtattaggtacataaataaattcaatgaaacactagtagcttactaatttatagattatagttcagtagttggtaaaaaattaaaaacctgcaaccatgcccggactgagctttgcatgacatcttggattatgaataagcgacctcgaactgcttcttgctcctcaatcatttgtcttgtacttttcattactccttccagcaacactcttgctgcatttcctctcaaatgttgaagaagttcaaaaacaatttcctctcgtgcatggactgaccatttcactcttataacctgttaggtcatacaagagataaaggtataaaattttgtgtacacaatttacataattacttatgtacccaattttattttacttttacataattacttatttaaataaattattagagcagtgcaatcaatgaaattgtgcgatatgtaaaagtttcactcgctacaacatttcttatttttatttaacaaagctacagtttgtagcagactctctaccagtacagtattagtcatgctgtaatctgcataattacctgggttgataatcttgtaatttcttggttcagtattatagtgaacagatgcaaatcctcatgattcctcctaccaggaaggaaagaacattgtgtatccaagttacaaacaaaaaagataaaatgcacacctatgtcgcacttaagttcttatatattttataaaaaaaaaaaactaatatatagtggttcaaagcacttgcaatcacctgttcataaacatcaattcaacttcatctgcagccccaaagatgtatttacgaaacaacctatgatatcatgtgcattagtaagaaataattatgatgacactgcactgcatattagataatgattttagatcacgatagaatgttgaaaaagtaaaccattcacaaagatccaaaacttatatttatcaccaagaaaactgattaatatagcttacgctaataatagcatcagattttaagaataggaaattaatcagtttcagagaatattgttaacaacaaattaaagagagagaaggaaacagggtgaaattacaaccaaattcagtctaaatatatcaaaatgaaacaaacaaaacacgtacataaattaatactagagctaaagccataggcccactacccagtttgatgccccaaaaagcaggatctatgagggaaattctatgttgaactaaactataaccttgtgtgactgaacagaaccttttgacagtagtaagaacaaacaaaaagggggattctatctttctctgttcaattcctttctttttattctttatatggcaagtcatggatttcttaatcctagtttcactctctgttcatgcctttcaagagggcaatgcattccttctaatcaaaagtaactggttttctctatattattttttcttggatagaaataacaaaatccaagaataaataaatcttctatgagattaactttttaagtcatataaatatgatgaagagtttacaattattcataatcttcacttccatgaagaggatagaaaatccatttactgaatataacagatcatgaatttccactacacatgcaacatggtggcttgcatcatgacacacagtatgtttctctttagcatatatgcatatgattgttgactatgaaaaggaataaccaactgcaaacagtagttgttgaagctccagttgcaacactcagacaacccaaatagacctaaatcatattttgaacttcatacatttggtcttaatgtgttatccaccagataactttatcatgttccttcaaattctgacagcaagcagataaagcaatttcatatattctcccaaattttatacatactcttttactcactcagatattcgttacaaaaatatttttttcctccattctgcgtgtaatttaatcatatctaactagcaatagagcttagaaatagtatacaaatgtatatatgcttgtatttttcagatagtatccagatagcagtttaatttgaagaattacaattcttgtacgctttaccttgataaaaagcattgtctaataaacacacgctcttagcaatttagatattcatagttcaggtgtaaatttaattacaccatttccaacagattcaatcaagattatgtttatctgatatttggaagttatatatagaattagcagtggaagaaaacaaaatcaaaatattaattaaagggaaaacagtaatcatcaacagcaaaaccaatagaaaatctaatttggtaacaagatataactaatactaacctatcatcccatcgggcaagtcggcaagctaggtgtgctacaacctcatgaatgctgcacggtatgttagcccctcctgcagccagcagttcctgtataacatagttgaaggcaactaaggacaaaaatagtaaaagaactatacttctggcggaataattctttgattaaggatttcaatcctccagagttactctcagaactgcatgaatcccattcattcaatttatttcattatataataaattaatatcttccaattaaatttaataaacttcaattgttagatccacaacagccgaggatccatatctgactgtctgatgaatgagggggcaaaaagactaactgacctgaacttctaaaacacctaacacattgatatttgaagcagagcccttaacatgcaaagcagtcaccaaaaagttttgtgccagccatgcccgtaagacaacgggaatgtcatcttcctcggcaaatggatccccagcagactgccctagaagttcaaataataatcctccagcaacacgaactggaacctatcaaaataaacatcaataattaaaagcttattttataaaatcaaatgccttttcacctttacattgagtcattgattttactgaaagaagcacaacaaccaaagacattttctgaatacaacaatttgcataatggtaacagcaaataaacaaattagcacaattcactttcagtctcaaacatcactagtttattcaattacctcatacagaaggtgtttcattctgtcactgattaatctactttcttcttgcaaagcaatgctgatggcaggatgcaaccagcgagaactaccaaaccatgcagtaacaaaaggatcagaagcatccaaatgacaccaccaagtgggccccaccggccgttcccagtaaggagttgctacatctgcaacaggaacatcactctcatcatctgtgaaatcaaaaggcggtgaatcaccaccatgtactgcctgaacaagttcagaaattctatcccaaccaattgatctccagtaactccttggaagaccctctttgcaatacaaatgaggtgacactgattggtaaatctggtcaccaaaatcatctccatgtgattcattcaaactgtttccaattctccctacgcaataatcactctgattgccttgaaaccccttcttcttggtaggtccctttcccctcatgaattcaaatgcacaaataagtccattagtccaaagttccccaccctgctgcatgttattgttattctctctggtggaataatgggttttgtgattcccctgattcttcatttcactggtaaatgaagctgaataatcttcattcacagctcgcattttgctctcaagaagaggaactagagcctcctctaccattgatgagagagttaaatgctaatgaaaatcaaagcatcatcatcacaagaaataaacaatcaatgtcaacttgatcacgatgatgattcataacataaaataaaacctcagaaactagacaaattaaatcaatatcaatcacagggttcctaacttagtactaccttgccataaacattaatgcaatgtctgcaaattattatgatgatgatgatttcaatttggatgcaaagcacaaaaataataaccacatgcaacaattaacacaaattaactgttgaataaaattgaaatggagaaaaagaggcatactcgaactaaagagaagagaagctaggcttttatttatcggagaagacgaggagaaccgctacgatggtcatggtcacactcagtcacggtcaccaactcaacctctttcacgtaacgccaacgttccattaatatatgaaatataatgttgttatatatatatatatatagagagagagagagagagagagagaataattttgaaaaataatgaaattatattattaattaaaatatcaaaaattaaatatatttactatttcaaatatttttaaagaaaatactttgaataatagttataattttttaaaaacttatataacttgtttataatttgaagaatattgattacataaataaaatataatttttataatttagttatattattggtttgccatccgacacatacaaaatatttgataggattaaatttaggctaaaatgtaattatgatcctcctattttttttaatctataattttaatgtttttattttaaaattaagatatttgattcttttatttttaaaaattcataattttggttagattctcgatttttttacattttatttcttatttattttgttttggtttaattgaactctaaatctaacgtattcatttaaaatatcttcaagaaatgatttaattaattacaaagtaaaagataaaaaaaataaaatgtaagcaatattaaatcataattgtaaattttttaaaatatgtagtcaaaattgtgtcttttctaaaattatttttttttaaaatagaaaaattaaatgtctcaattttaaaatagataaatcaaaattacaaattaagtaaaatagaataaccaaaattgtatttaagcctataatgacttaaataaaattataatctctctattttatttatgtaatcaatatttgaattatagaaaatcaataatttaagcctaaaacttacataacttgtttatcatgtttttattatattttattcttaccctgttttcatatcccaagtcacaaccatgaaatgaatcattaacttaataagctgaaaataaattcaataatttattagtagagattgtcaagacttacaatagtgattgtgatggattttatttatttattttgctaaaagtgatttcgatggatagagataataattttatttttactttttttaaggcgatggaatgtgaaataaataatgtaaatacagaaactcaaataattaaataccgtaaataattcaaataataacttcgtataattaatattaaatagtaactcaaaaggtacaattttgaaaaggtacaccaatccaatttagtgattctaaaagcaaactacaacaatttggtgaaaaatcctttttatgactccctgtgaataatgttttaggtttaacttcaagtggtaaggaatactatctttggtagggtagagaaggcaatactgagtgaacaagctggtgtgctgtgcagaaaggatcaccttacgtgactaattctaatggtaatcttattttattgctttctagttaatgttgcatgtatgtatattgacgtgggtttcattattgttgctttgtctttcaatatattgtcataaatatttgcaatttatgtcagaacctggtgaagccactgaccaggaagagattgagttagtttgtccttcagttacattaattttccatagcatctgttatgggggaacatacgaataggtgagtttttcaagcaatctgcttgttcacgcgtgaattcaaaggaattatgttttttatttaattttgatcatgccgtgtcgtgtacaagtgatccttcttcaacagtttaatttaatctcaagtaaacccttaaaattgtttaacccgtataacaatttagtccttaattacaattttaaaaataatccattaagtccttctcaactttataattaaaaagtcactttcatacatgcattagttgtataataatatatagactatatccctaaaaatttgtatgtgatatgaaaatgaaactccagagggattatgcaaaacatcttcaacatgcattattaatttgtataactcaaattattccttaacattgttatttgcagactaaaaatttagaattttctttgtaaatattatattttattttaatttttcattagaaaatgttaattattatttttgttaatttttcttaatagaaaaatttaaatccacaatttctctcctcctttatctttttctctaatcgtcaaatcaaccttataatctcattttacaaattttatatatgatgtgagaaatgaaaatattgtataatgatgacacattggtataacactgtcatttgaaaactgcaatatagaattatttgtctgtaaaattgatgcagtgattccatatcagcatttgctcaagtttctggatctggaatctcatcaagttcaagccattttccatgtcaaagtcatcctgaacacccaattactggcaattcacaaacaacaaacatgactgcatcatcatcaagggctgcaatatttgattttcaaacagaaatggtggatgacctactttcatctcttgaagagcatgaagaatactcaacagcaccatatgcccaagaccttattgtgcagtccccaaagcactactactttcaacaatttataagactaccccaaggtcttcaaatagcaatcaagaatctgcagcaagcattatctggtaggactgcatatcgaatacaccaatcttggacctaatttcctcccatgcatagattgcctccaatagaatatcatgcatttggttctcaaattttttcctctcccatccataacgttgtaagttttcgatctgtccaataatccatgcatgtatttcttcaagtgacttcaataagattttatcataagctctactttaatggtttaggcgttgtattatttcaggattctgctctactaatactaactagatctttattgtcattaatatcagcaaggtatatatgtttcctttattgggtcatggagctggaccaagatctttgtctttatcatcacattctcatcagattttggctcccttaccgtatacacttgtacagtctcacattctggctccttctccaccaacaagtgctgtgcattctcatattctgacttcagaaagtcctacaaataatctagttctgactactccacattatacaagtcttgtacctttaccttctcagaccctatacatccaagaagaacttggcagcaaggagattttcaagatttgtcatccgacggattgcatcgaaattgaccaacaaactaccactgacagcagcttactttctacgtattatcttttttctatgtttctttcatttttactagttgcacagcctaactattgaaaatgtataatttagtttttaataacttattaattataagaacagtctcttatttaattaatgacatgttaacccttttaaaatatttatgttttctatttctagacacgattttgaatttttttttataattatttcaatgtgtaaagtgtatttcattggattcatctacatgaaaattataagaatcaattaaggatttgtttggttaagtttctttataagtacttttaaaagaagaaaataaaaaaaaaataagatgaattttttcataaacaaaaataagtttttcattagctaattattagacactcattaatataaaagatgagatgatatatacaaataaactaatgaaaaactcattttaacttatgaagaagtttattttattttattttttttacttttttttttctagaaatacttctagagaagtttacatccattgatattcaaagtttgaaaaaaaaaaaaaagaaactttaacaatattacaattccataaaaaatgagtattatgagtaataaaaacctgaaaaatctaatatttatattcttttctcattgataataaggctcactttttacacggttttcattggttttagtcgttaatttttttttccattggttttagaggcgtcgaatatttacaggttgtgacccataataagtccaattccaattctattgacactaaaaaggaatccatgcttgatgcaatgcgagaggatccaaaactaatcagatgtctcagacgttgtatatgagaagatctcaaaattagatgctatgatagcgtctcaaatgttgaatatgcagtaaaaatcgtgtggcttaccatatatagcattcaatgtgaattcctttctaacgtctctaacacagaccttctagtgaatatcaaccaatgtggattctttgaaatagttttacttaatttaattaattagttttgatttaaaaatttgacttacattttaaaactacagtctagttacaatatatcaaattgatgagatttatttttctaagattattgtcaccttattaaaagttaatttaaatttaatttttatatatcacattaaacatacacaaagataatatatcttgtttcaaataatttatttccataattccttccacaattttagttatcttatatctttaatttatttactatatattaataaaataaagtgcctattttaatactaaaggcatttttaatatttttttctttatgtgtaaatttatcatatttagtaacatgatattttccttacatgttttaatttaaaaaaaaaaaaaaatacttatactttggaaatatttgtgcatgtcaagatatgtttgtgcatgttataatatttgtgcatgttttaatttaagactgtggaatacaagaccagacttggatcatgtcaagattccaaaagcacgagagccttctattctcccagtcttctctacagttatgcataacataaaaaggctcagagagtttgctagagacactgtgaaacaaaggctccaaacatgttggaaatgccaacaaaggtttgtacagttggtaagaactgagttcatattccataaggatatataagttcattctattgtcgatgtgaaaactttggtgagagatgatctataagcatctttgtaagcgttttttttgagcctcgagacctccttaggtcttggtggaagccggtagtttgcatgattcaccacctcttcacctccctccggttcctcaacctgtccttcaatgcattatccagcaaagttctttaaatctcaggactcagcagacacagaacaagacctcgagcagaaaggagaatttcaagatttgtcatccaacagaggccaggaagaacttaattgccttggaagccattcttcttggtcacgcttcctctctgtcccctcatgaactcaaaagcacaaataagttcattaatccaaagttccctagtggaagaatggtacagtgcaagaacattgagcatcaaaactggtcaagaaatcactagcagcttagtattttccacatatcactcttcactgtcattttttataattagttgacaattgcttatgcggcaaaaactgtttgcagtgttagttgcagagctaacagaataattgcagtgttacttggccgaacagaattacacactcaatgttctcttcaaattcccctctctttccctcttccttgctcttctttctctacactaacttgacttattttttgtcccgagggagtgaaatagagtatttttgtcattcatatgtgcgtgagcgttcaattgtatatgcatcagacagaactgaacacgcatatcatgtttagaacaaaggggcatgcaattctatattattataatgtgagaaaggaggtataggtggctaatattgcgaagtaaagcgtaataattatatgccatgagatatctgttggagaaggcaattgacatgagccaagttaggcagagttaggctgagtaatgcaaaaaacaataatttgtggttggttggcattacttaactccatcctacaaaataatcattcttttgggatcctataaaatttattgtcacaattcaactacataagcaattctatgaagcagaaaagagcgatttgctctttgttactgcacattttcctcaaagtgtcttatgtttggtgaaatggatagaaagcaagaacaagacaacggaaactcaaacatgtctggcattgatgtagctctaatatctcccaaagtcccaaaagcagtttcaccagtttcttctgcagcagaaggggacaccttaaggcgaccacgtggccggccggccggctccaaaaacaaacctaagccaccaataattgtcaccagagatagtgctaatgcactgaaggctcatgccatggaagtgagctcaggctgtgatgtgaatgaaagtttgttgaactttgcaaggagaaagcaacgtggcctttacatactcaatggaacaggctgtgtaacaaatgtaacattgcgccaaccaggctcagctggtgccattgtgacccttcacggtcgattcgagattctttcactgctggggtcaatccttcccccaccagcccctccagggatcacaggcctcacaatttacttggcaggtgctcaagggcaagttgtgggaggtgctgtggttggtgctttgattgcttcaggccctcttgtaatcatggctgcatcattcatgcatgctactttcgatcgccttccattggaagatgatgaacttgcttctgcaatgcagaatcagcattaccaaaatggacgcacccaccatcttgatatttctgacttgtatgcaatgccacagaacctgctcatgaatggtacaatgcccccagagatatactcttgggcaccagggaggaacttctcaaaaacctgaaacttagcatactatttgttagttgttgtctcacgttcacaaaatgtactgtactgtagctatcaggggtcttccaaggttgacattgcaaaacaagatgatatgcttattctgatctattaagaattattttagcaaattaatgggtgtaatgattttcaatacaataagatctacttttcagagttaatattgcatattgcagcattttgtgttagaacttcaaagcaaaacatgcatgaatcacagaagttgagattggtaagtctagcaaggtttgaattacattcactagcaaaaaagcaaactttagttatcactacactaaaccagctaatagtaaaggttgtataaatatcaatactaaatagcttttttctgaaggcctaaagcaacagtttgagtgaccttatgcatggtttagccctgcagacagacctagattcaaatttatacaagcttaaatagacatcacgttttctaattaagttaccaatatgactggaataatttgggaagacataatattataacaataatgaaatggatttttgcatatttgaatttcatgtcatggccctgtgcccctatcttactctttctactttaggaactttttttccctaatcaaactaaaaatcccagtgtattgacaaacaaatcggatatatggttcgattgtgagatcctcatatattgtaactcttctctgtattagagctacttccttacatacagattgatttttaaatttcacgagttcatcccttcggagataatcaatcttgaagtacaaaactggagtcattcagtaaagagtaaatctctcgagctttaggatgtagcctccccccagccaagaactcatgaacctctccatatagttctattgaactgcatcctggttccttctctgccaatctttctctcatcaaaattctttgctccattgcctcttcaaattggttggatgcagcctgaacattagacataagtaaataaccactggcatcacttggatttaactcagagactctttgtgcagctcgtttcgcaatttctacattcccatgcttcctacaagatgaaagcaaagccccccatataataaaatctgcctttagaggcatacactttattagttgttctgcttcttctagtagcgcagcttgacctagcacttcaaccatgcaagtgtagtgttttatcgatggctcaatctcatacttatccatcatcagtgcaaaatagtcccttgcttttcctattgctcctatatatttacaagcagttaaaacaccaatgaaacttacatggtctggctttaaatctgaggcttcaagcttagagaagtactcaattgcttttctctcataaccattcatggcaagtcctattataatggagttccaacatgataatcctcttgtgggtgatgcctcaaacacttcaatagcctctacaatagctccacacttgcagtacatgtcaataattgctgtgagaacaatgacattcaactcaaaatgacccctttttacataatcatgaacccactccccatgtttaagtgctcctaaatgggcacaagcacttaacaagctcaccattgtaaattcactaggctcaaccctttctccctgcatcttgcggaaaagctccaatgcctccatcagcctcttattcctaacataaccactaatcatagaattccaagtaactctggttcttgtaggcatgttatcaaacaacctcctagacttatcaacctccccacacttagcaagccccataatcatagaattgcaagccaccaaatcaagttccagaagttcatcgaacactctcctagcctcactcaataacccactattagcatacatgtaaatgatagtattttgaataaactggtccttctcaagacccaacttaacaaccctcccatgaagctgagctccatcatagccagcacccagttgagcataagccttgaaaacagaagggtaagtcaagcgttgtggctgaactgatgaagaacacaacatatcaacaaaaagagatattgcaagatgtggggttgagctccgagagaagcctctgatgatggtgttccagcaataaaggtttgggcttggaatggtggtgaagagcaagtaggcatagttgatgtcaccggatgaagaggcgcagaaagtgaggacgcggctagcagcaacggtgtggtgagcaaggccggttttgacgatgtgggcatggatcttttgaaggtctttcatgttggagcattgggtttggagcatggtgaggcatggttggtcggagatgaactttgctatggagggtgatgatgatgatgatgataatggaggaagtgcagaacaaagagttgacattgtcattgtgtgtggtcgggactaaggaaagatagatgatgagtggactctacacttcccttttgagctggaaagtcataactaactagatataaatctgcaaactgtgggactactaaatatataagaaaaaaaatttatcccctctttatcaaattagaaaaaaaaattataaaatgtttttattttagtggattcttttaaataattcaggaatcaatacatgattataaaaatatgaatgttttaatattcaatagtttaaagccaaaaaaagaaaggaaaaatatttaacaaatttgtttgtccaaaaaagtcaaataatattaaagagtgtcgttatctttttcaaaattattagattagtcgtgttttacttaaaaagagtgtctttatgactttatctatttttttctttagttttattttctaatatttttataacattattttatagtattttcctattcaatgaatgtaatttaatttgtaacgcacattgaatttgtaggaaaaaaatctgggtttgatcttgcataatacatcacttggaaggtatgagaaattttagtgtgactatgtttgaattgaagattagcccaataactaccttaaagattcaaagtttataaaattacttagaggtttcagtagaaagataaaagctaaaattacaatgattaaaaaaaatagtatttttctaatgtctgaattctattatcgtgcattttttcttagaggttcttttgtaggttatttagcctttttcaagttgtttttaccattaagctccaaatgaattacatgtcaaagtatttaacttgatagttaaattatgatatttgtggccaatgcgggttggcagattggttaacaatccagattgaacttttatattttccatgggtgtggatttgaatctccttgatgacactttttctggtaggtgggcatccttcttcaaagagatcctttgacatcttgtaactaattgagtagttgtaatcgaatagagttacttcctttaggcaataaccctctattggcagtcctaggctcccagcatgtcgctgatattttgtgcagtagtatttgaagtatctttccattctaccattttgaacactaaaaagaaaatgtgatatttgtataagaaaaaattgactaaaatataataacttaagactcaattgcatttgattcattaatgtgggtcctgtttggatacaagcttctatttttttagaactattttattaaaaatatagtatttttttcagtagaaaaattctcaaaaacagttctaaccttaaatccaaacagattttatgtcacttactatcttttatttagcactttttaacatactaaagtatttttaaaataaaaataagttataaataaattcatgtaacctttaatcaaaacccgaaaatactgtaataataataggctatgattttcatgatataacatataacaaggattggatgattatcaattgtaaataaattatacattatcattaatattttaaattaaatgaccgttcaattctaagattggtgtcaatcaaataaaaaaaatcaattgattgtttgttttttaaataattgaatcatcaattcttgatgataaattattttccgaattaattgtataattacaaaattaactttagttttggggagaaatttttttggctaatgtatatattattttaagtaataaaagattttagattttaactttattgtctatcattatatttattaaaaaaaaaaaaaacttttatgatcatgcnnnnnnnnnnnnnnnnnnnnnnntatatatatatatatatatatatatatatatatatatatatatatgtatgtatgtatgtattatcaatcaattagaaattattttaagtgtgacttttaaagtaataattataaaattcaaataatttatcatacatatcaaattataattaaatgatagtattattttttttaacaataggagtgcatctagttaaatttaaatagtaattaattttaaagaaaataatatcatggatccttttgctggtatctctcttttgtttgatagttctctgcagttgcgtatcaaacagtaaacaattcctttatccaaacaaaaaacggtaaacggttcgaaattgttcaacggctaaaactcggagtggacttcgctattctcaactgggcctcttttttacaaaaaaaaaaaaaaaaactgtggattcatgattgtgtcattttatgnnnnnnnnnntaactttattgtctatcattatatttattaaaaaaaaaaaaaacttttatgatcatgccaatcaagaagcacagtttactcaacatataacaaataacattattttactttaaaagcaatataaaattgagaataatcttgtcttgtatgacatgatctaagtaatttgtagtggaattcaatgactttgatacaattatctagttagttcacttcaatatttaccccaaaaaaagtgagttaaactcacttcaataaagtttgacctttatgctgatgaacaaacatgggacatgggttgggctgcaatatcatggccaccgttctttacaacaaaagcatggaatcagctaaagttaaaattatgaaaaaagctgataggaaaatcaaatggcagcaataggtagtgacacttttgctcctgcacgtagaaatcacggtcaaataccaattaacaacccaaccgtgtcacaccttgattgaaaacaaaaatatcataactaaaaagaatacttttaattttcccttgatttatgaacataataactgcatgtgtaaaggcaggacatataaaaaagagagaaaatgagaaacacaattttcatatagaggatcttaggaagaagattgaatatatggagcgtttgagcaattttcattcgtgagaatcatgttttttttaataaataattttttaattgatcattaaaaaatttaaatttttttaggagttaaaaattatgatttttattgattattttaattatttaccatattatataattgcataaaaaataatacgatgattttattgtagtaaaagaaaaaaaattaaacttgaaaaagtaagttttcacttgatttggaagttttctattttcatttaaaaaaacataaaataaaagtaaaatacatttatttaaaatttagaaaatattttcaaaaataactaaaaacaacaaatcaatcttttcaactttttatgaaaaaatgaaaatgcgaaacattttaaagtaatttcttcttggtttatatttttcaaaatcttagaaatttaaaaatgaaaacagaaaataaacattcataaatacttttgaaattttttttaataaaaatatataacattttcaaataaaaaaattcttataaacatttctaatcttatattcaaacaaacttataatgttatacttctccaacaaagtactaacataatgcaagtcattttatattttagatttatatcctactaagaataaaggagaaaaaacaagaaaagaagaattagaataagtcatagacagaataagtcatagacaacagtaaaaggagaagaatagaaaagagaaaggcaaactgtacacatcagcaccatcattacgatcatcacttacaagcccacaaaccgagtctatattccaaacaattcttcctttacttcgttttcaaccttcttccccaccttttccctcctttttgcaccctccaacactctccctcaccacaccccatttttgctttcttaaaccctctcctttgtctcagtcaacctcacagtcttccactaccactatatatacttttagttgcatgattaacccacaaaacaaccatcttcctttttttccctctctagttcatcatatcttcctttctctttcatttagtcaaaggaagaactactattactggggaaccacattgaaaaagaagtgagagaggacaagcaagtgccaaagaagaagaagctgaatagtaagattaaagatggaaaggagtgtattttattatgtaatatttctcttaatgtgtcatttcctctgttcaggtaatcccctttctctagtttattctatagttctatcttccttcttcttcttttttatctttggtttagctctgatggctctattctgatactgtttcttaattctcagtgtctttggttctcatttcccttctttttcaaatttccaattgcttattctttatctcctgcacatattctgtgtttttctctttaatttaattgttttggaccccttgaatttgttttgaattctgaaaccacaaaaagctttttccttctctcaagtttgcatctcaattgttttattctcttctagttttttagttcaactagtaccattatggatatacattttggactgattaggagaaaatcacttcttttttttagtttgatagtccaccttggcgtctttctgttggaatatagtttactaattgagcttttcacttttttttgtttatggataataagtttcctagatcaaaatattgtctcttgtattattccattaaatacttgttccggcaattatagagccacaccatagaaaagtttaaacaagtccttttcttgctaatttttctggggtttcacatagtacagttcaattccaccgtttcttgaaaagatacaaagggcccaactgctttgactcacatatgcctctctctacataggataccctacctgtccttaactgactgcccttctagttgcactattccaagttgttgccttttgaaatgatggagaggtccaagtcttcttaagggcataaatataataattagtttggatcaaaatttctacaactattccaatgaatagcaaaacagattttgttttccataccagcatgaatgttatacttataggcacaatttgaatctagttacactttttttgcatccctttgaaaaaggaaaaggcttggattgatttcaaatctatattttgatttctctcttcacatgctttggacatatagtacagaacaaagtaattcagttgttatttcaaacataggttcaagtaggacacaaaaggaagtacctgtacatgtgaatgtactaggacatgatgaagggaaacaagaattcactgcctcaatttctacagtccaaagggatattaccactcccatcaccaccattccaaacttagttcccaccatttcaacatctccattcctgaatcctaattccaatccaggcacagtctctccagcctccacaatcccatttaccactccaaccactgtgaattctccaatctcctcaggtgcaagctggtgcattgcaagcccaactgcctcacagactactctacaagttgcattggactatgcttgtggctacggtggtgctgattgctcagcaatacaacctggtggaagctgttacaacccaaattccatcagggaccatgcttcttatgccttcaataagtattatcaaaagaatcctgttccaaatagctgcaattttggtggaactgctgtcatcattagcactaacccaagtaaggcctttgctgttataattctcgttgcaactttttcaataacgttacatgtattttaattttaagccaagtccaaaggtatggtcaagtcgttgggtatattgaaaattcaaccaaaaattaggcttgattacaactcttttccttactttttcaatttcacaacatctttcaatattttttttcttccaaatttgagtccattattttagttgtggcatttttatttatctgtttacttactaatatataatatttaatagaaatgtcaacatgtcactataatgcattatcacattaatattttcatattgacgtaatattctattactatattattatattagtatttatattaaatattagattataagttgacagataaattaatgcataattaaaaatagagaccaaattcacaaataaacaaaaaataaaataacaaaatttgtaaaacaaaaaattaaacttagaaaatagaagttgaaatttagtagacgatgaaaatataattataaatggaaaggagaatgcaaactagtagtagaagaaacgtgtgccacatagtttaaaaaataggttgggtgattaagtcatgacattgggtcattagattattggttaaattagtgaatcattaattgattcgtatgatttgatctgtaataaaaaatgtaaaatttttatatctatcttaaaatatttttcctgatatattgaaattcaaaagtattaaaaaacacatataaaatataaagaatacaagttaaaaaatgattattatctctaatatttagcattaaatacatcaacgataatatatatcaatatttacactaaaatgaaacataattatatcacatcaatgtagattataaaatataaaaattcaattcaaagtttcaaatcacaagtttaagaaatgatctgagatcacaatttcacttgtaactcaaacacaattacagtcatgtttagatcaatttaactcaacaaaaaatgcaattgcaactacaaaaatgttcaacaatgagtgaaaatatcaatttaactcaaaatctcacacaaattaaaataaaacaaaatgaaaaaaaaaatctaattggactcacttgcacctctaagaaatgttacaaatgagaggaagaaatgagaggttgtcgagcgaagcaactgagtaagattactgagaagaaaaagaataggatgataaagtttctaaaattaaaatggattcaaatttaaattatgtcattttgattttaaaaaaaaaaaaaaaagtgatcatctctggatcgatgggtcaccgttcaaccaaaattccgaccgatgctttgggttaaaaaatgcaaccaattgaacttgactcaatcctatgcaactatcgaatcgtgattcaacttatcgggtcgatttgagttttaaatctctggtgtgccaaattgatacagagagaggttgggtcccttgggttggtaatcagacgcatccctgcgcatgattgttaggttccttccattctaaaaagactacaaaaggaagaaacttttattgcatatttgaattgattatagcctgtgacttggggttggggatgcagcagctacaaagctgacatctgtgtgatgcaaaagtcaaacttttattcaacttttttggaagcagcatctccaaaaagcttcctttattggccaattggggtaattttttttcaaatttatcatttgaagataaaatttaaattaatattttaaaatgggtaaatggtaggtaatttattatttttgaattaaaaattataacatgtattattatttcttttttacatgaaaatcataaaaaaattattttttattattttaaacacatcttaaagtagtaagattattttttcactcagccaattttaaagttgtaattttttttcttttttcattaaaatcgtatattattttacatcttcaaattctttttgtacttttcttaattataagtaatttttactttaattatttaatggatatttttagttttatttaatatattttatattttatataatattttatttaatattatttattaatgttaaatactattattgattttgtaaattaagaaaaaatacaaaagaattaaatacctgttatcacaaatagtatctataagtagctattcatcgcaatttttttcattaattgtgcttatataccttgcttacgaattatacagagaaaaataatattagccacttatattcaaaatgaagtaacataatgctttgtacaaaatttatgaactcagtggttaggattatttacggataataattattttttaaagattttaacttaaaaaattatgaaaaatatttcttcaaaaaaataatgatatatacacaattattttagtttctttttctcttaattgaatgcgttgcttatttaacgaattataaatttgtaatattcattctcacctcttatctgaccattttcataacaattttttttgaatataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtaagattttgaacaaaaatcttgagttcaagatttaatctttattaaatttctcactaaaagagttgaacatatctctgatatggagaatgagttttttttagaataacctttaaaatatgcatattgttaaaaaaaaaatactttctttctcttttcttcttatatctcaaaataagatttatcacgaaagaaaaaatgaaaaaaaatcttgaaaaattttcaattttacttgtgatattatattaaaaaatatctaaaatttcaattaaaaatctaatattaaagatgcatttaaaaaatacttttgttacctttatcttgtacagaacatatacattaaaatttgatgtacatttttgttttattttccagcatagaacactatgctcctccaatattatttaatttttggttgttgagaacatttgatgaatgcatttacgtgttttgcaggcactggggcatgtcaatatacatcaactaggtgacccaatcttgtcatatatatgctttcattttttttaatatacatatactatgctttatttgttaatgttgcaacaattggaacagaaaatatcatattaattaacttaataattggtacctaaaattgcagcactagtacatcagtgttgaacacaacaaactcaagcggtgccaacgtttttggttcagtgccagtgcctacagaaccctctccctatgctgctgctgcacctgacacattaaatagctttgcagatatttgtgtcgttctgtggataatttcaactttcaaagaaattatctctgaaatggttgagagttggcggttgctgctctgagtaaataatttttgccccttttagatactttttgggagacacaaaagccaatagctacatgaccatcaacagcacataaatggtagaaacatatggtagaaagaaaaggcaatttaagatgatggacatatgtagaaatatatactgtacataccttttttattttatttttgtgttgctcatttttttacgttagaattgttagaactcagaaaaataaatatatctttgaagttgccttatgaccttatctgtttagttatatgaaccaggatcagttttcttgtctaagctaaggatctacatctaatctaatttttaacaaacagaatggattacactaaaaagatgtaaatttcttacatatataagtgaccaactcatacaaacaatttttctttacgttttgctttatataaaatatcattatagaacaatttgaaccaataaaataattgttgttgcacaatttgcaatataatgtatacatgttgatttaaaatataatttcttagatgtttatttttttccaacgtgtagttaagatcaatatgttggcattacaaaagaatatgtgtagtggtgggtaccatcttttgattctgaccattggagtttgttcacatggcatgtactgaaggcacatgtcccttactcataaattctcacaacttcaactatgcaaaacaggaagagaataaacagtcccaatgtcccatgtcatcctacaacgggtttagggttacctttttcagtcactgtacaaccaacaaccttctttaccttcacaagtaataacttgaactaccttctaggaacatgtcactcaccacctattatacttggagtaaatcaataaggtaaatactaatcatttcattaagaacactggttaagaaatttaaaataaaaatatttttattgagaaataaataattatactgtccataatttttattttattttttatgatttacataataaacaataaatattttcctcttttaattcttaactaatgaatgtctttaagacatcagttagtaaaactcattgaataaatgtataatatatagtgacctttaaattcacatcttaacttattttaaaagaaaactaatcatcataaaaaaaactaagtttatatgaattattttttaaaataacttttgtaaaattaagtttgtttttgaaagtaaagataatttactttttttaaataaaaatggagtgtaaatacatcttaacttattttaaaatctaactcatattaaaagtgtcttttgttttgtctcgaactttagaagtgtcttctattacagacattaactcttaatttgttagtgtggttttgaattttgatagaattatttttcatggaatcgagtttgggctgttaatggttaaatgtgattaatatgtgtgtctaaattaatgtaaaacacacgcttacattagaacgtgtattttttttattaaaaaaaagcatgaaagaattttgttactttagagcaagcagttacttaatcgacaaataagagtaatttagaagtactattaaattcatttaattgaaaaaaaaaatgataactacactgaaggagtaacacgcaaggaaatgacaagttaagaaaatgtactataagaaaaattaaaattagtgggaaaattaaatataatttttttaaaaactatcactaaaatttttgtggcgattaatgataaaaaaataattttcgccttaaatttgatcactaattcttttatttgtttatagtaaatttatcatgtatactatatccaactcaaaatatcttgtttcttctatgcgtgaaaatattatgagatttctaacatgtatgatgtatctatcatttttctttataattctcatgtttatatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttacaaaaaaaaaaaaaaaaactgtggattcatgattgtgtcattttatgaccaaaagcttaatgtattgttaaatttaattattgtcaatactataatagactactttttaaatatattcattgttaactgggcctcttattcttattattgtccctcaacggctcaaccacacccaaaatgatataatagactacttgacagttaaacatacatttaattatttgatctactaactaactaatagcagaaaactaatttcataaataggaaaaagacaaatatgtgtgcatgtgtataaaactctttattatttatttatttttatttgagtttaattatttatagttagtgcaaaatatttttgtacaaatatttcataacttatacgtgagttttgttaaatgtctaaatctgatgaaccgacattccatttaataaactcacatagtcacatacccaacaacaaagagtgttataagaatgttttactatttcttgtaacattaatactcatttacgtttgtctaaccttataagttttttggagagtgatattaaaaattggtaaataagttccttttataataactttatagaacaaaatgcataattattttaaatttcatagtaaaaaatgactcaataaacaaagtttataactatcataaaatatgtggctgttccatggttttgtaagatctttatgcccaagtacagtcttgactttgactaaaacattgtttggcccatagaagcaacgtgtcttcatatttaaagtcttgagcaaaggggttggtgtagtcttgttagtttagttggtagttcccctgaccctagtgcaatattgcttgaatatgcctaatgataagaataggataacaaaaatatcttaccaaggctaaattctaaattcttctattttattaacatttcttcatcatattgctaaaaccttttttttttactttttaaatttaattcatgtcatgaaaaaaaatatgatgagttaattaatcaatttgtttacaaaaaggtattaaattttgactattttgtcaatgtaattttgttttttgcaatatttatcatatagtaataataaagtgcatacaatatcatttagtgaatattagattttagcgtagttaaattaactaaattcgtatcaacaaaaaattaaaagtctgtccacaaaaagtatgcggtgaaaattaacgtgttaacatattaaacccctatcagcagacaaggttaattagataaatctttcccatgacacattaattccttgaatcaataaaattaatgtgtctatctacctgtcaacatcatatgcatatctttgtttgtgttttttttttttgtcataatagtgataaaaggggggaagaactctatcttagtttaaaataatcacttaaagattaaaaaatatataataaatatacacatgagcaaagtattaatttattgtatacactcagacatacaatagacatgacttggagtgctcctcttattcttattataccttgcattgcatgattctctctctaatttgttgttatttattgcattttacttagtatatccgtcacaatagacacgttccttgatataagtacacatgctgaacattttttaagatgtacaatttcttttaatactatctttgtccctgtaaaactcttctaactaatttacaagaattaaagaaaaagtagttaattcaatgacattaaatttactaataattatgtcatctttatacaattattttatggtaactaatcatatcatttttttctttgttcattccatctaattaattaatgtataaagaaaatagtggttatagaattatcttatccaatattcataagtgcaaagaagaaacaatttacaatatttgttatttattaactaattaaatttatttgataaaaaaatattaattaatataagagacaattctttttatataaaaacactcttacaaaaagtgaaatacaaatttggtgtaagttatgtaagcctcatattcctagtcaagtcctagttactttaaagaagcacagtgtacgtaaagtaaatatgcttgcttgacactgtcattccgttaatatcacaatcataaatgtcatatccaacaagaacaaaaaaaggaaaagaagaaagaatcacaaaataaggcaacataaaaataagtgtataaaacagtatgacatttcaaaatatcattgaaaaatgaaaatcccatatttttttttttcatatctatcaatagtattttctccacttgtcttcttgcacaatcccttcattccctgccagcatcatgtacttatccctcctagtaagtgtggtgcacgcaaatcccaaagcacaagccaactgttgctgtatatagtttgccacttcacagcttgaccttcctccagcacatgttagttccttgggaacctttccaagaacctcaatataatagctaggccttggattcatgagaaagaaaatagggtccaagcatttcaaaccacttgctgttgtcccatagaacatgctcacatgactattgatagccacaggaacaatctcatcagccaattcagcaaacagtgagctgaaccttagtaaatatggttctctacaagttgttccttcaggacacaccactaaatcaccttctttgaggagcctttgcatggtttcaccatcttttcttctgtcccttgttagtctcactgtcctaataggggctatcaactcagacactttgcttaggctgtatgtgactgcagtcaaaggctttgccaaacatgtgcttaggaaaacaggatcaaggagagtcctgtgggagcatacaaataggacccctttgttttgctctgacttttcatcagggacattgcctttgacttgcagatttataccactccaaacccctaatgccattgcccatccataaggaagtagaatacccaaaaggattctataaatggctaaaagaattcctaatggaaaccacataaacatatatagagttgctgagggagtaggcaggaatgctagtcttccatcatggaatattaggggctttggatatttgtcccttggcaacactgaacttgggttgcccttgccctcttcattgttcaccacatatgcttcctgtcattatcatgtagctggaattaggcacaatacattaatagatttaataaaatcatgtctactaaattacaatctaaatcgagattttaaaaaaataaaatcatccgtgactgcaattttgaccgcaatgtcaactaaaactataacaacattggttacttttgttcgtaagttcctacaatattaaagatcgtgacacaatcgagacaatgactgcaggttaaaatcttgatataaatgcaatagatttataatatgctgtgctaacagaacttatcataaagggaattaaaactgttcaccagaacaatacgtacaggttatatgttgaactttgattagtctttgttttttcaatttaaatggttttgttttttttattaaggcgtgtaataaggtctcaggtccttggtgggttgtggaaacagtgaaaggttatttaagaacaatgaagtattgaacacgcaagagttaaacagttagtgaggtgattaaacagtggagctaacgtgagacttaccttgcaaagggagagaaaaagatgatcatgaacactagagcttccaaccccaatatcaggctttgtgtctccaaaataatccttcagtgctctgtgcttcacaagtaagccagaaccagaaaccaaaccactgaagtagcaaccaacagtgtgcaactctgtgccaacaacagcaccgacactcaaatactccctaagaaacccttccaccataactctaggcacactagtgaaaacaactttagaccctgctgaggccagaacctcataagcatgaaggttgagattctccaaataaaacttgggcaaaacagcccttgacatattttccatgacacttgttcttagcccacaaaaggtgatgaaggtcatgaccctaagacttaactcatggtctaaaatccacaacacgggacaagacaagagcaagaggagtgcccttaaaatgctgccaccttcaaaggcaacaagcatgaaataaggaaagaaggagtgggacctcaaaaggactctatgaatgtcacaagcaacgagtgtttgtgagcttctaccctccaaatcacatttggtaacgctagggaaagaagaaggttgaaggggtggtttagatgacaaataccccaaatggaatccataactcttcatttttcttgctgctctataacacgagttagcaagcagctggtacaagacccagtctgcaagcctcagaagcaccattgggaacaccatgctatttttttttttctttcaaattggttgatggtgatgataaagagaaggagcaagagagtaaatggaataagaagagtgggactgtgtctatctgtggtgaagagcaaagtgtgcagagaatatttatagagtcattaaaagggtgcaggagaaagttttcatggtagcatttggttaaccacaccgctggcaataacttcaccttccacattttttttttcttttcttttgataccatttttaagcattggccataatagtagcattttttctttcatgcaagtgccctctacatgttgccagataatattagcttggctactgctgacataaatacagtaggtaggttaaaatgttggtgaccgcttaagagagagtctttgtttgaaatgttggcccaaacacacactgtgttgcctattttaaatgacatcggcatgtgtgtatcatccctttgaaaagcccttcgtcaaataaatttccatccaatacttgttccattttctcttgccacaggccaatggcaagttagatcacccacatcatccaaacaattgactttttaaaccaatagcagaatcatccctattcaaattgttcctatcaataaaaactgtcgttgactactagttctagttctatttctatattctgaaagaacattgatgatagtactcagtagtgtcttggttaaggaattaagaataatttttaattgaaatattatatttttcatgttttttctctctttatgaatatgtgatatatatttaaaaaaatattttttattatttagtaagtgtccggtccggacgtgcgggttagtaagatttaattcttttttatatatatggctttttttattgttagataaaatatatgtgtaattttatttactgaaaccttgtatatataaaagattgtttgaaaaactatgttgaatggtagtagcatttttttctttttattggaaaaattttatattaagataaaaaaaaagttaaaaagctacttgatagttgaaggttgataattgaaaattgaaaattaatatattaaataataaatatttgataaaattaattgttgaagtaattaaaaatataaaataatttaaaaaataaagaaaatatgatttataaatatgtgacttatttaaaaagataataaaaaaattggatagatatattcaaaataaaaaaatataaaaattataagatagaaactaacattttaaaaacattactttaaataatgtttaaaaatatttaaactattaaaaaattattaaaataatttatttatcaaacaatcaaataaatttttaattaaaaaaattatataaattaattaaaatattttggacatggcagactgagtattaaccgtttgactctgttttgttatgttgttgtctacggctctatgcattccattcccaaggctatttactgatcataggtgggacagttatagggtttgattttaattgcttaactaatctgttgtctgtgacgtaattatcgcaagtcccgtgattcatttgaaattaattgtttaattgagataattaggcccttcggcaaaagcatactttctgcacagtctgatatatctcaggagttacagtgacttttgcattatattattcaaattaattaaataatagtatatatctcattctataagtgtaattgtttaatcattttatctgcatggtacttcttttacattaaacactagacgcatgagtagacttatatgttttgactgaaaatattagttattcgtcacttcaacttaaatgaagccatatttatgatagtaatattgtgctgatttgtacttgagaagtgagaagctagcatctgttttttccattttttgtttttgttttgccataaataatttattgtttttgccatttcgtacaagccagacaaggtaggtaaaggttgagcaaattattcaaaatgtaatgacatgccattggtacacaatctttgaaaaccttatggaacttaattatttctttgctgttctgtttgttcgtgtgacggttagaacaccaattcatgtcaccctcattttgtggtttggtgaacccttaatcatttgatatggctgttcaatgcacatagtttgcatggaatcgttaagaagattcacgtatctatggcttctcatttcatttctgtttacccttcttgcgtttcttgagtcaataaaataaaatacaagtttccttaattatttgtattattgaaatatatatatatatatatatatatatatatacatacctgggtgttataactaacaaactgcaactcaatgcaaaaacaaaacaaaaaactgaaacttacgagtaattgttgtccaagttgtcgggtcatctagtacacacatatgaaatatatagttataatatattccaggtgaattcatttggataaggccactacgcatgctacccctaattaactagtatttttcagtatagttttttcatttaattaaaaaaattggataattaatttttatacaacaaaaggagagatgagaagagaaaaaatagaaacataattattttgattatagaaataaagataaaaaaaattgtattatatattctttatatgaataacaactcgaaaaaaaaaagaaaatgatgcctgtataataaattgtacaataatttgtacaaccaagagagagagagaaaaaaaatttaaaatgtaataagtgatgagtcggatataaataaacactaacaaatgatgttatacaaattattgtaagtttatcacatttctaaaaaaatataatatttaagcgaaagaaacacttgaagcatgtatgtgcataaataaatatgtaaaaaaaaaaagaagcaaaaatcgagaaaggcgataaataatgggagagggataagagtcgccaaaggaaaaaaaactcgaattgataaaatgattttttattatataaatatactttttttcccttttatattatctataattttaagagttttacattagtttgttcaagaataattctaaattcttcaaacaatgagatattgcaaatagcatgtcaagcaacaatcccacttggtattgcttgcataattttccaagccatacacaattgacacaaatacgtcactttcctaaataaagctaaagaatatgcacgagacgttaaaagttgggtgagcttgcactcaagttcttaaaaaaaaaaaaaaaaaaaaaannnnnnnnnnnnnnnngcaagaagttcataaaaagtcttattaatttatttcatacttggttgcttttttgctttgattataatttctaatgttttttttgtttttttctttatttttttaaatacttatatgttctttatttttaactaagtgattaaatacaaataattaatgagttgatagtctttgcttgattatatgtgcatcatgttagttaaaatttattaaaaatgataaaatcatgaaatagaattattaaataaaatgtgaaactcaaaaaaaatataaattttaataaatttcaaataataaatgataatgtgttaaaaaatgcgtcaaagaatatgttattaccttttctttaaatgaacatacaaacataacaaaactcagatttacctgttgaatgaattgaatataaatacattattttttataaattacttatagatgaacactataaaaataatttaattataaattcacccaattaagttaattgaatcatcgcctacaattattggttttttttttttcttggaaagaggaactgaatgtggaggcccaatcaagtgctcgcctaaaacttcttacatttccactattgtttcctacacttcccattgtactcccattatttttcattttagaatgagttttccataatgtaatggaaagtgcaagaaataataatggaagtgcaggaagcaacagaggcctaggccctgaaaggaagtgaaatgggcaaaagaggcttaggcccattggtgtgtcagtttcccgccacatatatgttgatcttcccgccatctcattcacacacaccaatcacttcgctctcgatttcttcctttcccacttcgtgaacacaattctccaattgattcagttcataatttcggtcgcaaagcaaatgatcccacatcaagaacccgatttcaatctcaatcacctcaaaatatattacggttcgtcactttcacttcccgtttcgtctttttcttttaatctctgtaccaaattagcatggttttcattgtttcgaactgggttttaatcttttcaacgttttctcttctcttcttttcgttttctccaggaaagctgtttccttttgctgatttagtcagatgggtgtcttatggcaacggtaataatatcgccaaatccatgcttccaatgggtgttgaatggcgatgcattcttaattttaattttaaggattaaatatatatttagtccttgcaaatagtatgttatttgttttttagtccctctaaaaaaatcgtgtcattttagttgtccctttaatgggtgttagggtgttgttttcgttcttcacaaaaattcatctcttttttggtccttggtttatgtaaataggaaccacacactgatgcattcgtagattatgactgaaaacatatttcactctaattttaattttaatttgtttttatgggggattatttgtagatgggaagcaccctggttgtgatcaatcctacattgggcgaagagagttttccttcactctggagaatgatatatatctgcgcttccaatctttccacaatgcccacgagctcgaaaactccatcaaagaaaaatgccctgttaagatagatattggacctgtctacactgttgatgtaaaatgtccacttatatccaaatcctctctacctagatttcattattatgcttcaagtcttttataattcatgcagctataatgattaatgcagccagcgattcttttcttcattaatctgttccttgtatttggttcagcctgcaaaaaggaatgcctatgcacagagtggtgataataatgtctttgccccagttgagagggagttgatttttgatatagtaagattttttgcttcagtctttgagtgaagcctttagctattgtggccttcttcacatttgacacccttttgtattttgggtttctataggatatgtcagattacgatgatgttagatactgctgttcgggtgctgatgtttgtttggtttgctggccgttgatgactatagcgatcaaagtgattgatactgccttaagaggtagtattttgcatcttatatgatattggagaagtggtgcaattttgtcatttatattgttcattacattgaaaaaacaattattgaaataataagatagcagtacatctcatataacattgaaagaccatggagttgatgtaagtcacctggcagaatcctcctaaaataacataagtttgcctcacaacaagtatgattctcccaattcataacatagggaaagtgactctactggatttggtcatctctcaccatgataggtttatttttgctgaagcagaaagagacatgatttctacttgaaaatttatgataatagttgtagtccaggctgtatcttgtacgtttcattatttcaacataatttcctgaacattgttattgctgggaaatataaggcttcaacaatgcctaatatacctgttagaggaggctcaatgcttaagttagccttcactctgtgatatatgtatggtatggtgttgtttgattttaattacacctattactgtattacatgctttgaggttcatcaagcatctcttctgcatttatttccatcccatttctgatcttttattgtgcttaatctttattcaatgactgagtttttttgtcctaattctttatggcctttgggatgctcttcatatatgaaatggtcaaaatactatgggagggagggatagaatatgcaacatgcattaaaattatatttaatagcttcgtatatggcaagattgagcccatctagtggtgattgcacaaaacaactgggtgttatttgttttgggagggggggnnnnnnnnnnnnnnnnnnnnnnnnnnnnnnnnnnnnnnnnnnnnnnnnnnnnnnnnnnnnnnnnnntttggtttcaaacacattctctgggtatatagtgggcgcagaggtgttcattgttgggtctgtgatggaaaggcaagaaggtgaggcactaaacagtaaacaatcaaaagttatcctttatctacttgtggctgtacagtcataaattaaaataggttgccttcactcatacaggttgacaaatgagcaaagaggtgctattgctgactattttcgtgtctacaaggtatagtataatgatgacaagtgggtttgtcaatacttgtataaactttttgttgatttcatatgctgtccagggcaatgaaaatagtcacaagaaggtttctttgatgggtgctgctcttcatcctttcttggcgtaagtcttaatatgaatcattaactttctgaaccagatctcttattttatatgctaagcagtattttatttttccaggacatcatacactaatgttctcaaggactattttgagaacaatctgcttacaggtcaaaatttacttgctaccgaggagagatatgagaagatccttgacatgattcctgatgaatgtactttgttttctgtcctcccttcatataaaccttgctctttcattccctgctattatcttatgcaatacatgggttacttttgcagccattgcttctgaacttaggggaagatggcaagatagtaggcggtcttctagtgcaaaagaagacatcaatgttgttcgatgggaacagtgcaaacagttgctgcaatctggaaaacataaggtattcaagcttccttttaagaaatgtagaacaaggtgacaatgcaggaaatgatgcaggatttgctgaaacatgtatcatttgatattgctatttattattaatgttttctaatcctttttgtaggcacaagggctgcgtcggtgcattgaagagattgtgttctgctttacctatcccaggctagatatggaggttcatcttttaactggcctttttcccatatccactgttatctttcatgctatagaagaccaataacaccttttgactaattttaagtttagtctgaattttgttcattaaggctgttcatgttttaggtttctaaacacatgaatcatttgcttaaagcaccattctgtgtacatcctaaaacaggttagtatataattatgcacaatttttattgacataaccagttgaattttttatgaggcttgagaaatcactggtgacattataatcatatggttttatgattttatctttatatatatattttgttttttactatcttccagttaaatttgattgatagatccattagctcatttgactgtttagcattacatggtattattctttgttctaggccgagtttgtgtccctattgatccaaaacggtgcgaggagtttgaccctactacagtacccaccctttcacaggtatacttattctgcaatgatagttttctgatatgcattccagggagagaaaaactttccaaaacggtgcttagttttcaatagccatgttttgtatttactacttctgatctggaacttgcattaagacacttgctcccttctccaacacattttcatgtgtgaaaaggaaaacacataaggatgctgctttctgagaatttctggacatctcttgtgtttatgtgaatcttgacattgtgagttgtatgtaacattgcagctgatagaagagcttaattatgaagtctcaagagctgatgttgatggtggtatgttaattttatactcaatccaattttcctgtttattaaaatcttcacattgccatcaccacgtgtcttggactctggggatcctgtttatgtacattgatatgttccttcaattctaattgcaacttggattccatttcaagggaaagtgatttttaatgccttgtttgatagcagaattcaatagaacttcgcttggaaatgctattacacttttcagatcgtcattcttacagcctttactaaaagcctgcaaggtatggatcatttcataaatgttggtaaagtttagtaattttcccttaaacatcattttattgcattaaaaaacttatgcaatgtaaaaaccttgatactggtattatgaatcatttggaaaaatctattccatgtgaaagaagtaatatgagaatgctaggaatgactcattttctgtttctcatttatacgtgtatttttttttctttattacaattcaaattctttaaaacattggtgttgatcttaataatctgataccttattacagattcagtattcaagtattaccttacctatcataagtattttaaataatgaatattgcaggaggagatagaaaattcctataacttaaaattgcagcagtcaaagaattcccttgcttggtagtgccacctattattgattggtcaaatagagctgtcttggggtcacacattagttgacacaatcaaatgatgaaatgttcgttgtactgttgaatctttttttgtattttcttgcaactacaaccgttctttctacttctggtgagagaaaggaagatgatttgaatctttccatccactgtataaattttggatgaaacagttaggtgttccgtgttatctataagaatgtgtttggatagagaattttaattggagaaattaatttattaaagaatttaaaattctttaatttaaaatttattgtttggatgtttttatacgaagaatttaaatttttaaaattttaaaatagaattttaaacaactaaaaatgtagaattttaattttcttctaaaatgtgagaaattgaaattccttcttctataaaagttctcactgcaccaatctttgctttgtctccatcgtcgataagtactctaatttccgttactctcacgacaccttccttgtgcgtctctctgtgaatgaggtttaaaattttaaaatgaagaaattcaatttctttatccaaacacaaaattttgaaaatgaaaaaattttaattgatacattttaattttcctgaattttaaattctctgaaattttaaaatactccatccaaacacattctaaagatatttttgccaatgcatagaaatagtgaggtatcaatttccattgaattcagcagtaattttaatgtaaaggactacaagtttattcatcatatagttttccgggtattttgaaaatttgaaggactgaaaatattactattgtcacagcacagcacttgcagtaacactccaattttttttttcatactttgtctggagttttgttttatagaaaattaggtaaatgaccatgctaggtcttattgtggtttccattaataaccgatgtagttacttaattcccactattcttaaactagtccactagatcgtttttgacattgcgtggcaactaaggaaaaatgtgtttcttggtgtgctgttactaacacgtaagctggtaaagtctctcacgagtcaagattatatagtaaaaattgttattatgtggctgtgaagcaagttatatgaaaatacaggaatagcaaacaaaacaaaccacaacatgacattttatgaagtccaaaatccaattggatagcaaccacactgcgagcagccctatcagttgggtaggtccaaccgacagagaaaaggtctcacatcttcgctggtgttcatatggcaaccgtatattctcgttgcccctcgatggaggctaggaatatactcctattaacccttcatcctaactcaaattcttaagtatggttaggatgattttttttggcattgtctgttttagtgttcagtgatccatcactattttatttttagtgaattatgagagaagactatttataaacttttcttggcttcaatttttaagccatatgaaactttttacatgtaatccacgaagctgtgtacttatatacgactctacatgtattgcttccactaaattagtaaattagacgccaaaacgtagggaaaggtcaaatatgtaaatatgcagccctgtgctcaagacaacaatccgtacattacgcccaagggttaattttttttcggctgcttatgattattgtgtcaactcaatcgttcatgctaaaatctttttttttttttaataaagatgggcttgaatactgagtcagtcagaaacaagtaattccaactaacttggtatcattaattaggatagaaagaaaatacaaatcaaagaaatatcattaaaaaaaaaaatttacaaaaagtcatgggggacaataatcaaacctcgtgaaaattcaacttatctgttaaaagaatttataattagaaagacttgtcttatttatattgtattctgatgtcacaaaaggaagaaatcaatcccaccagtagaaaaaattaactatagttgcaggagaggtaagaaaaattgtataaatatcgtcttttatgtaaatatgacctatttgaaagttcatgctcaaaattaaggtttttcttattccaaaaaataaaataaaaattaggtttctgttttatttttctcctcgaaagtaaatatcataaaatataataaataaataaataaataacaacgatctaagatgtcatgtctttttttgtgttattatgacgcgaattaaaacaaactacatgaaatgtttaatacaattaactttttaattttaatttttataaatacttagttttaagttaaattaaaaattaagcccctagacctgacatcattttttgtttcgatttttacaagaaaacattccacattttattatttacacgagtaaatggtccttctcatgttacaatgatattagattttgtccttatagttactatttttcattttagtcaccatgtgaatgaatttacacttcattttgaatatttttttaaacttttctttgttatatacttaacacactttttccatttaatctttataggaaaaatactctaacactattataactagggaaacagtgtctctaaattttttaaatgataattaaaaataaaagttaaatacaaataattaaaaacgtgacagaataaacaaaaaactaacaatatagaagtaatgaggagagttactataggttaggaaaaaaaatgaaagtttaagaaatggtttaaaactatctaatgaaatgaaaggtggataacaaatggaaaatatttaatttattattagtatagagtatagataatgttaagaaaagtttgtaacttttttagaattaatagtgtatatattgaccgttcaaagaatttttacacgattgattaattataaactatcatatacgataatttgataatttattaacttttaatttattatcttataaaatcatataaaaaatgatttctaattgattgatagaataacttttttttacagataatacataagaattaaacacttattttcatgtgaggattaaaatgtaaattttcatgtcaagactaaactgaaaaaataatattaagtgtgtaaggactaaacttttaatataaccaatatttttattagactctttacatttttttaaatttaattttaaaacactaaatcataatatagttatgtttgttttgttggcttcttacttgacaaggtgggttttgaatgtgctatgaaattaccatattatatactcgtctctctctctctctctctctataatatatatatatatatatatatatatatatatatatatatatannnnnnnnnntaatatatatatatatatatatatatatatatatatatatatatgatatgatatttgttaacatgaaaatatataaattcaagcacaaatttataacaacaaagagcaaagttgtaacaccgtagtccatatgaatgtagaacacaaattgaattaacctgttactaaactaaatcaattatttatgtagatttcgtttaacataaattcattgattacttatttaattgacttcatcactcataagtcataacgaatattgcaacgatgtcacatatacgaaagaatgccaaaaaatttgtattttatcatgattgtgccacatcactttacaacatcacaatcttttctttgttccctcgcttaaaaatatcaaaattctatatgcatcatgattgagccaagatatataacaggccaggtaagtccccccttatggctaattcaagaatcttttttgtcatatattgactattggttatatatactattgaagaaaaatcaagaaatttcacatattaagaaaataaaaatagatcgtatttatggctcgaaatctacatttgaaaaaatgcacaagaataatttataaatgaaataaaaacaaaacttgattgtttaaaatcaaattcaacaatacaataatgttagagaataaatatgaggtaaagtccaaatatcatatataagtaaagataaaatttataaatctaaactttaaaattttaaattaaaatatgatatcaaattcactatataactttttgatataaatctttcctatttatccccttttcaacacacaagttgcagcatgaatgaaaagtgtactcttttctgatttatttcccgttaattatttatgtatttactagaataatttacccgtactttgtagtttgcacggtcagcagaacaatctaattttagtgaaaataaaattataaaaatcttaaaagaataggagagagggtgcagggtattaaaatcttgatgaaagttatcgtttgttgtctataagaaatgcaacttcaatttattatactattttactgttgttgttacgtcacataacctccaaccatacgttgaaccctgaattggtgataattttctttgttattttcaagtcaatgtttgcattaatttaaactagaattgaatgacaagagggacacgaatgaaatggagatatatagaggggttgctgattcgccaacaatacgtttcagaacagataaaatgtccatattggaggttgtggacaacctttcatgtatctaaacacctagcttagtatattcttatgatgacttttttttagtaaattactacattattttggtatagcgttgtcctcttagtttttaaaattattttttaatataagtttatgatattttaagtttttttttttatataaatctttaaacttaactatttactattattttgcttcctatacatttgttaatattatcatttaagttacattttttaagttttggactgtaatgtgattgacgaactgcacatttaaaaacttatttaaatttttcttactttcaaagagattaatataatagtgtcatacatttttaataactaaaatgattgtttattggactattttgttagatattctattttttaattaaaaaacacatcattttttttacagcttaaaaaaacccatcaatgacaaccatcaaactacgttttttctatagtatctcacaataaaccatgcatatgtttcacattttatatatcacttatataatataaggttgagaggtcttatgattactttgtcttttttataagaatttaattaaaatatagtaatagtatatttatttatttattatctagtcagtgtcatgtatgataatattattttttataatattattttaaaagttatatttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacactttcaaaaactatattatattaacaatttaattaggaaaatgctagcagacacaaaaactggttaagaaaacaaaatagaaaactattaaaattatacaaaaaaaaagaacctttctgtttcagataattcttgattttagtaaataaaaaagaacaaatagtaaccaataatcttaaaatattattaaaaattatttaaaaatgtgttgttaatacacccttaacataatttcgaatatattcttaacatgattttaaatgaaaagttattattattaatttcttacgtaatattttaatgatatggcactagtcagaagctctagtaaaaagaaaaaacaacaatacgaaaccgtgttggttcatgagtccagatagggtagcgtgaacgtgaaacacgcgttgcacgtgctatgttgcgtaagcatgctcatgctgctccccactttaatattgctaaaatttacagcaaattaaagtatgtagacattgaattaaagttttgagcaaatcaataatgtattccacatttccgctactaaatgctactccttatcacatcaaggataaaagtatgtaatgttttatttttaataactctcaatgatataactaaaattatgtttgcttggagtataattttcgtataaaatactaaaaaatgtcaatgaaatggtttcaggtgttagtataatttttaagaaaattagtataaataattattgtgacaaataatataaacctataatatatcatgatttatgtttaaatgataatataatttttttacatataaatcatttactctttaaaattttcaattaaaactaaaaactggagtgagatgatgcagaccatattggaacacctacacatactccccaacttctgagtcaccaatccttaaaatggacgatacgacattaatgaggatcgatacgacatctcaccattttgatatttttttgtatttttttactttgctatatagtacattttttataggcacactatatttttttaacatattattaatatatttttttagtactatcatttaaatatataattttgaactttttttcttcatttctatgatatatgattgttaattgtttcatcacagaatatcattcttgcgtttgtattattaatgtcttattagaagaaaaagacatatttataaaatggtatattttcatttcaaagatatcactgtgtttgtactattaatgtttcattacaagaaaaagacgtgtttaaatggtatattttcatttcaaatatttccttttcaacatgaagtgatattttacacagaaattcatcatatattttacactttgaataatggccgttcagaaaattgaatagcgacgaattttttagtatatgttaaatccttggtcaattttgaaacattaattgaaagcataatgcacaatttttcgcttccatttacggtatctaaacaaactacattttcagaataatgctcagttctataaaacgataaaatgtatacacactaatggaactgttttattggaaataattttcatcttcaactatttttctatggtttatactgttaaaattttgtgatcgggaagcttaaaaatcacttcgtattccaatttccaacaagcagtatgccactatgttatacacacacacaaaatataagttgaaattaactttagctacagattaaagagagcagatgacagactaaatagaactaattttatatattaatctcgaccacttggttgttgagaagttttttttttataatttgattgaatagataatctcttatatccttgttttgatttttgaaaacgattcactttgtctctgttgaatgtattgataaatcctgtgtttaattaggatgtttggtattgttgtgcaagtagagtaagtgtaacggaaaagaaaggtcgaagtctatgagtattagtactacgaaatgtgtattaatttgtcatgcaatttctacaaatataatgcagcttaggtttaggatcatacggggaacagaaaaaagaggtgacaataattgatatatacttgtataaaacaaacatcttgatttgatttatttattatgttttaaaatgctcaatgaatctcttgggatatgtgtaaacaaagtcacattcttcctatgtgacgtgatttatttatttttgtgtagaagcctttaaagtgtacttttaatctacattattcggtcaccctgtgaactgcactgacattaattaataacagtgaattttaacatgtgtttaactaatgctgtaaaataaaaaaacatgcgttgaattagcttatttttacatcatctagtatcatataaaattggattatttgttctaaaaaaagaataaagaattatttttattcctcaatatataaacaattgacaatctaatatatgaaaaatacaaaattctgatttagttctttaatgtctaaaatgtacgataatgcgtttacccttaatttttgtttatagacataacgaaacatactagaagtgaaaattgttatctttagaatttcaatagacaacatgtttggttttgtggtgaactttcaaaaagcgtgtaaaataccaaagcaatgccaagttgcttagcaatcaacatgaaactaattgagttttttttttttttttctaactcgttgcaaaatcaaacatgagcaaagtcatataattaaatgaaacaagttcattcttgaaatatacaccttacggcccgtgttattgtcactaacaatactaacaccaataatatttacacctaaattcctcaacaaaatgtcttgtttcatttcaaagacaataaaaaaaatcatatttctcgtgagcatcaaaagaacacattttttccaaaactagttgataatcaagatcgaagtccaaagcatttcatattatttagaaatttagttgtttaataattagattgaatatcaatatctttatcaacttaatttccataatgaatcagaattgagatatactttctcatcacaaggaaataatgatatatatgacatatttgttaattgaacttaatactctcaatataggagtcaacattgctttaacctaaaagtaatcaatatttgcggagttttttttttttatcaaatttggattagtaaactttagaaaatcctcaattgaactttctcacttcttcacccacaaactttctgaaatgttaatatcagcttcaccatcgtcgtagttcctaatttttcatcacctaaaattagaatccaattagcaaactctttaacctttgttttatattcaaagttacaaccactataaactcacgtattttgtactgatttaaacactttgtaataaatttccataattttgaagagttaataattgtcaatacaattttcactttgtttacatttggaataactagcaagatatatttaaaaattataatcataaaaatcatataattatacttttaatttcagctaatttatagaatattttaagatgaataaatttaattctaacctagtataagtacatagtcttaagtgtaggatcataatataagcaagcaagtggacaagttataaattagttttaactatagttttggttttctaatttggattatttatttggtcatttttttgaaacatttacaattttagtttcctaaagtttttaaagctaattacgcctcttacttttaaaattgaaaataaattatttattgattttcttctacaaagagccatattaatttttctttctaattttttaaccaataaattttgggattcataatgaacttgatacatgaaataagactcaggatcaatgacactgaatatctcacttatacgacttaataattttatgaaaaatacaaaattaaataatctaatcattatattaatttttataaaatatattaaaggataaatattcatttcatccttgaatgtgtagagcattgacaaatttgtctctaaaagatgaaaattcaaatttttgtccataaaattaaaaaatgtgtgacaaatttatcccttcgttaactttcctccgttaccgttaattgaaaaagtctaagtgacatattcaaggataaatttgtcaactttttacactttcagggacgaatttgtcagctctcaacccaaaatataatttaatcttcatatttttccttttttaatcattacaagcataaaattataataaacacttaaaaaatagaaaaacaaatataagttaaaacaaacataataataaacataatattgattaataaacataatttattttttattctgaaatttctattgtaacaacattaagtaatgacaaaatcaagttctgaaattaatgacataactggtgtgcattttttgtttgagtatcatattttgggtaaggtactctcacaatagaaatttcaaagaaaaaatatgagacaataccttacccaaaacatgagagtcaaacaaattaaaatgcacagtcattaaattaatccttataataaaaaaatgagatacaacttgattttgtcattatctaatgttgttataatataaattttagagtaacaaaaaaattatgtttattaattaatattatacttattattatttttgttttaacttatgtttgttattctaatttttaagtatttattataattttatgtttgcaatgattaaaaaagggagaatataaaaattaaattatatcttgagtagagagctgagtaatggacagaagttaatgaattgataaatttgtcatacttttttctctttcagggacaaaaattgaattttcatcttttagagataaatttatcagcgctccacacatttaaggacaaaaataactatttatcctatattaaatttataaaaaaaatcatgttaattagaaactagatgatagttcatcctaataattaaaacaagtgatggtaaatgttatagaatttttaaaaaaatgctatattgaaaatttgaaatttaaaaaaatatcggagtaagctgaaaggttaaacctgacacgtgtttggcacattccctgtgccatgtacgttggagaggggacagacaggtaattccacaacagtaactgccaccttacttcgtcacctgtctttcggaacctgaaatcacgaaaccaccctccacactttctcaaaataccaaatacgccccttcggtataataagaatcccaaatccgtatctcacaagcgaacgcgaagcagagagagagagagaagagccgccctttcttacaataaacaacaactcattctttcaaggcttcaacaacagaaactttcatagtttttcactccttctccctgtgtcggtgtgctcttcttctggggcattcgttttttgcttcttcagctccaacttcaaacgtgcttttggtggaagaagcttcactgggatcactatggtgggtgtgtgagagagggattacggattagtgagtttttgtcactaagttagagctatgtcatttcatgatcgaggggtggtagcagtttggtgttgggattgaaggtggggctttatttggattctgtgtttgttgaaggagctggggtaggtggggcaaatgtgcttgagtttttttttatgccaaaattgaagcttacctttctatgaatttcttctgtttcgtattggtggcttaatttggagtagctgttgcctcagaatgcagcaagatcaaagaaaaaaggtgaatttgttgtttgttttcctcatttccaagcatgactctaattaattgctatacaaatcattactttttcaagtttttctctgtcccgaatgaattatgaaggtgccctttttgggactaagctgagtttaaccgaatgaattataaaaataaaatcttgtcttgtttagtgttggtgggttactacttgctaccgagaattttagattacataagtcaaagtgtgggagtgaggttctgttaagttggttccatggggctgtgttatgatgttagttagctctctcccaatgtttaatccatcacgtgacataatttatttccccaacgtgacatttggttgacaagatctttatttttttcaccattttttgggggggtataatgtgttgatgaaatttgcataacgcttctttgaactgggtagatggcattcctagggttgatcttccatcccaatcaacccacccttttgcttttctttgtttctacgtattctgagatgtgtcttgcacgctttaggtgcgttgtacgagattgactctccgaaataaacgttggtgaatgacaagaagtgatgatttggccaagaaaaaaaatattcgtcttaaaatgaatattggtttgtcataagaattgtgatgtgttgagtggttttaagtgctgtattttccccttcttttggctttgttaagctggggagtgaagcgttgtatggtgacaatgtgtttctttatgtttattatttgttatttttcttgtgttagtccaatctatgcagacatgatcagattactgcaaatataatttctactctctttctttgagtctatgattcttcaatactgagtttcataatgtaaattctattgcacacacaaattttgtgttgtgtgtattaagcttatggatggatcatggattccgagatataaattaatttcccttgtaacatagcaaagaaaaattatttattactttaatttctatttatcaattatgaaaatttgtttcccaattgatgctttagcttgatttattatttgtagacaatcaaatttgggcttgcctgattttcctttgcggattactttaatatctttggtacagggctcaatggagatggaatttttctccgactatggcaatgtcagcaggtacaaaattcaagaggtcattggaaaaggaagctatggtgttgtttgttcagctatcgacactcatactggcgaaaaagtagcaattaaaaagattcatgatatctttgagcatgtatctgatgctgcacgtattctgcgtgagataaagttgcttagacttcttcgacatcctgatattgttgaaattaagcatgttatgctgcctccttcgaggagggagtttaaagatatttatgttgtttttgagctcatggagtctgatctgcatcaagtcattaaagccaatgatgacctaacaaaagagcactatcaattttttctttaccagttacttcgagcattgaagtatattcactctggtattcttcaatatttgataatttacttgttcatgaatatcttctttgaatgcgcattgtgttgctagtggctatagcttgttttctctctacaatgacatgtaattgaaattgtgtcattccttagcatttttcttacaaggatgtctggatcatctatatttttttctctaactattgctgttgttgacttttttttgcacctcattcctggatctccttaaacttgtatagttcttttatggttttgccaaaatgttttacttattcatttgtcctttttatattttactttgtctatttatcaacataagcttgctggcatcaatgtcaatattgctcaccaattacatttcaacacattgcagcaaatgtctatcatcgagacttgaagccaaagaatatactggccaatgcaaactgtaaacttaaaatatgtgattttgggttagctagagttgctttcaatgacacaccaacaactgtgttttggacggtattccatcccaacattttctctgtttgtttcataccttttcaacagctttgctagattttttgctccctcatatcaaaagtattggtaacataggggctgatgttttcttgcatacttaatacttttctataggattatgttgctacaaggtggtatagagcaccagaactctgtggatcattttactcaagggtatggccttttcaagattttcagatatcatataagtggtagagaacctaattatgcataatcttgactcacaccatacctaattcatgctcattagttttgtgtgtagaaattgtatatcaacccatgatacatgctttctgttatcttctttcccatcaatagctaaaagtaagacccaagaccaatctgttatttattcttaatccactggttttctgtttctattagttttattttgtgtctgctgatgagctaacggtaaggtattgactgcagtatactccagcaattgacatttggagtataggttgcatctttgctgaagtattaataggaaagcctcttttccctggaaaacatgttgtccatcagttggatctgatgacagatttgcttggcactccctcgctggatactatatccaaggtagtttctttttttctctatagagggaaaactgtttgtattttcttaactaagttttactaacatcattgtttggctggtttacaattttgaatctttgtgttggatgcaggtacgcaatgataaggcacggagatacctaactagtatgaggaaaaagcagcctataccatttgcacaaaaatttcctaatgcagaccctttagcactacgactactggaaaggttgctcgcctttgatccaaaagaccggcctactgctgaagaggtttttatattgttctctatttcttatgtatgtgtgtgtgttgaaaaattattctactcagataattaactgcttcttgagcttatgctttttctttggagtttggacaatagaaatgtataattgatgtgcaacaatatgtgacttccttgctttagaattctgaaggatttgacattttcaggcattagctgatccttacttcaagggactttcaaagattgagagggaaccgtcctgccagcctattacaaaaatggagtttgaattcgaaaggagaagagtcacaaaggaagaaattggagagttaattttccgtgagattctagagtaccatcctcaactattgaaagactacataagtggaacagagagaactaattttctttacccaaggtttttatttttggtttatcgatttatacttcaactgtttatcttcttttccttaatattttttattcatatgttctaccctattattctctccttacccttcattggtgcatattcttcacagtgctgttgatcagttcaaacagcagtttgctcatctcgaggaaaatagtggtaaaagttgtcctattatgccacttgaaagaaagcatgtatcacttcccaggtaattcactaatgtagtatctcattggtttcacttgtcattggttgtaatcataggttgttaacaataggttactttgattatattatatttaagatatctattcattagatataactggttttttaaaacaataaccggttatatcaaatcataacaggttgtacaaaattggttttggttatggttatgataacaacttgtaatctggttatttagtagttatggttatggttacttgaataaccaaatcatgaacaacactaggcataactcaatcccacaaaactcacttgtaaggtgaggattatccaaacttcataacctattttaacatcatatctctagtcgatactaaatacaccccctcaaagctgcaattaaggcagcccaaagaggttgcaactaaggcacagctcagagaagctgcaattaaggcaggtcaaggatgaccgcaattaaggtgactttccaacagtttttacatagcataatacagtatcaaagtggtgtttacaccttgtagtcaaatgttgagatcttacatcgactagagacgtggatgtgaagtctaagggttgcatatacccttcacttcaaacccgctgttgatatttatttgagccatggtttatattgctgctaattagcgagcattaaaatatttgtcctacagtcattagggaaggtacccctagtggattgaagaccatatcaacgggtcttccatcttgcaaataaggcatatcctgtttagacaaattttttgaaacgataccttcatttccatgtcccccagccacttaatctcctactttaatttcacgtttctgtaaaatatatatacgaatcccaccatcctatttatctgctctttgaatgtctcagcatggcatgagatcaaatcgaccaaaataatccacatcttctccaggctgcatttgctgttacaactgtttcattcatagggagcctaatcagattacatcatactgaactttttgtttgtttgctttcctcttttttggaatcattgacaggtcaacaattgtacattcaaatatagtaccctcgaaagagcaatcaaacattgcttcctgcataaaccagcaaacaactgaggaaaataataataattccagggatacagaaagtcctgcgccaaggtctattcagggtctgcaaaaatttccacaaggtatgtgactgttatcaattatcatcatgcctttgttaagtttgtatgcattattagttatcaataagctaacattcttgtgttcagcaaaacctggaaaagttgttgggccagtgattccatacgaatatgcaagtgttgtcaagggtacatatgatccaaggacatttatgagaggttctgttcttccttctcaacctataccccctacgaatcattatcaaagatcaacctctggaaaacaagaaaggtcagcaacagaagctgacaaggtgcctttacaatccaaacttgctcagcaatgtggtgtgaatgccaaaatagcaccagacatagctataaatattgacaccaacccttttttcatgacacgagcaggagtgaacaagatagagcaggatgaccgaatagccattgaaacgaagttgctgcagtcaaaggctcatcaatatggtgggattagtaccactgctcatagaaaggttggacctgttcagtatggcatgacaaggttgttctagaagaatgttgtattgtgaatagtttggccagtgggagcaatacttgtggagaataagaaaaggttcttcatagtggagaagcagtagtctctggtggtgctttgtataagacgatgatgatgacatgagttagtgcttccccagaaagagccagctttctctggtcaaaccttgtaaacattggtttcagttatcaataaactgtacaaccgaatttgagtcctatcttgtaattcaatccacacattcctttgctcaggatatatatttttttaaaatttcctgcaataactattttccaagtagaaataaataaatcagaccggtacatgtacagatgtactgctatacgagtaaaaatgtggaaaatgtaaagtgttttatgcgtgttatacacactggacgcaaaggagtttcattgtttaaccatagtgttttaaccccctttggccattatagaaacagattcctcacaagtttctttaacaactggattccatttaaaattatatcaaatggttcaaatgctaccaaattttcctcacctaggcacagtaacaatttatccttgaaagtaggtttggtgcttgcataatttccttctatttatgttttttttattttgaaagaagaaaaatagacacctcattgttttattggaatcaaaccccaaacaaatagtttgagcattggatcgaatacgacgtcacagtatttcatatgattttgaaaatttgaacggacatgtgcccaccttctcccctcatggagccacattggccttccatgtggaggaagttactgcagctaccttttggaagctctatctaatagctagctatacaggataagattaactttatgtggaggcttgctttcagaatgtacaaccacttgtaagttgtaactcttggatttttctacttcttacttccgaatagttaaaatgctaatggtggaatgtgtgatgcaaagagacttgtttaggttgttactaatctatcagaaaacctggtggaacagtcttgtcagaataatgttgcattgcaatttgcagcccacataatagaattgaagataataaaaaaaaaaggaggaaaaaaagagccactagatgcttggctctaaaatgtactgtaacattgttgatttacattaatcattaatttaatgtcatacattaaaaacattaaaaagaatgacctagaaaatgaggtaaatccgaaattcagataatgcatttgaatgatctggtcgcttgtttattgtttggcatttactgcatatgtaagctgcagacaacgcggggctcaccaataaaagtctgagtcagttcatgtgctgatcattaagttgttattatcaggttgagaaaaatcctcattcctccctctctacaagaccaactgtgaatattcctcaccagctgcatgcatttatttttccttttccgttttctaaacctaattgctgatattgttgcaataagttttgctccagtgattttttttttttttccatttacctacgcttcctaaaaatggatgctaagacttccctttccttgtttgaacctttgtgatgccatcatgcatgcctagttcatttatattcatagaattttctttaattaaagatgattaattcaatgtttggttatcatcattcacaatatgattaaataagtcaaatgttatcaacatgggttaggtctatagagaaggattagtatcttataatgtgacgaatcaaagtttaagttttcatgtttactatctgaccaacgattctttaagtaagatcgtttctaacaaaaataaatgtgattagaaaaaagttaagtgttagttaatattcatgattaaacatgttaaacatttattatgtgtattcttttatgttttatatatctatgtcctcgtgacctactaggaggggaaataatggaaacatgccattaggtatccctagaggcctaccatgtgagagcttcatttgtttgcaccgtaagatgattttggagatgttaataagtccaaaggatgaatagataaaggaaaaaggtctgttaaaaaattgtgaacagaaacaaaactcaggtaggatgtggacacacttgcagttagattagatgcatgacattgaattataatagctctctcatcaatgatatatgtgccaagcaaagcaaggcccctatgtaacaaattgatttcaattttcgtacaagaaatggtggtacggaccccattaccctccagaacaaaattaaaaaaaggaaaaagagttatgaaggattgaaaaaaagggtagtgtagtgtgtgaatgtgacaagaacagagggatccgagtgggtctgagcacatggagtcccatatgcccaacacaaccaaatctctcatacaatcccaatgacccaatccgccgattggtttccttcttggaaacaccaccacctcccctctctcaactcactatgatgtaatgcatatgagggttctaaatgcatcaatcttcttttcactctcttatgagtatcatcacacttacaacaccatctagtttctcaattttttaatctaccatttttatcttataatgttgtgtataatttattcttaccagtatttcttaatgaattgaatgattatataatgatattataaaataattttataatttcatataatgatacattattatttaaattacttttaacataattattttaaaagttaataaattatgattgaattattgtgtgtatatttttacattttcaatgtataaccgtttacccgtttcttaattatataacttaaatacaaataataaacggctataaaaaaattgtattctctctctctctctctctctctctctctctctctctctctctctctctctctctctctttcattttggtgaaaaatagttagtataatttactttcttacaatatctcaagctttcatcaccgttcacttttttcgtccttttatttatgttttctttatcttttactcacgatcaataatttttgtttttaagaacatattctttaacacacatctttaaacacatcctctttaattaatataaaattattaaaaactataaaattagaaaaataataattaaatatagtatgagactcacaaaatctaaatatttttaataaattttaactaattaaaaaaaagtgttcaaaagaatgtaataaagaacgtctttctattatttatctctctctctctttttttacatagtgactcgatttttgtttttgcgtgttctgttaaatttatcatctgtgcaacatttttttattgaaaaccattcaaggcagttgatacctttcatttcagattattgatttttttttttacaggtatttattattatggatacgacataataaatcatttaataaacatattgtagtcatgtttcttctgttttctctttaattaagggaatggcgtatttttatacgaaaatgccacttaaatgcgaacttaactagtttatccagaaaaccaacttgtcctaaataagctaagcaaggagtatttgatttccttaaaatgccaagttgttagtttaatagggttgggattgatatgattctagcaatttacatgattaatttggcctaaaagggttagaagggggggttttgtggggctcaaggtggggtcattggaaagtaaacacgtggcagtcatgcgaagggtggtgatggagatcacatggcatatgaatgaaagagaagagagtggagaggcacatgggtgggtgttaagttcaaggaattcatgtgagcacatgtgctttctcccctttgttttgtgtcctgtgggaccattttttatgctctcactccttaacggggttgcatttgcattttgcagtcacttgtaaactttatactttcacctttactctccaaaatcctcttttgaatcttactagttaagaatccttaaaatctaatgcccatacatattttatagactattaacaagatgcatgtgtttagcatgctataattgatcataaatatccctttagtgcatctaagatgccactttcctgtgatcttgcaacaccctctaaaagctatggaaatagtaattgtttgattccttaaaaaaaattagtttaacatatttttattaataattattagaatactatgatatttttattccaacctccaaggaaggaaataataagcaatgaaaaagtaacgtaatactttaattttattataaattttttattctataaccttattaaaaacatttttaatataacttctaaaataattattataaagataaaatttagatacaaatctatacgtgttatttgctttttttataatcaaaattaaagtttcacttctataattcttgtaaaaaaggattatgcattagataaaatttagatgcgggttcgtttaagtttttctttcggtaatacaaagtaatatttaataaaattctttattatgcacattatcgaaattaaactctaagttgataaaaaaaaaacaacatcaacagtatttatgatattgcatttagattttgtttattatgaagacaaaatcattataaattttgaatttattataaaaataaacaaatttatcatataaaactattcgtgacaagataagaaagtagaaaaataacttcacaaagataaacaaatttagaagggggagggtaaaaaaattgatgaggggtgttgatgtggagcgtgaaggccacctcatcgctccaatccaaaacttggggggcttcttcttcttctttgtgttgtgaggccaaaaccagtgggaccagcttcgttggcattgacatttctagagctcaacaataatttaacatcttcctccttccctccctccttcgcacacaagacaatcacacctcatataactccctcacacattaatctcccttctctctctctctctctctctcacacacacacacacacacacacacatcaaattagtactataactacatgtcatcaccatcatccatggaacaagaagataacactatcatacccacattcctcagaaaacctgcagaagaccagaacaacgacaactctcccaccccttctcacaagtctttgcatgttttccgccgcagcaggaggcggtggaggaaggaagtggcagtgaaagatgctgtgaaagaagacgatgaagaaaaagaagaaggagaagatgagggtgatgacagagaagatatagagaggaagattcatgcattacagaggattgtgcctggtggtgagtctttaggtgtggacaagctctttgatgaaactgctggctatattcttgctttgcagtaccaagtcaaagccttgagggctctcactggtttctttgagaagttggagaaggagaagacaaagtttggaggttgatggtgaacatcaacatgagatgatgaatgaatgaatgaataatccatggtgatgatgatggattatggaagcaagcagcttaggttaggtccttttggtttttcccacagaccccattcgttagaatttttatttttcttcttttaatttttatgttttgctttgatgtacttttggaagttgggatcaaggaaaatgtttatcccatgatcgatgttcttagatttttaattttttaatttttttttaatttttaattttgaagttctcatcagttctttctttctttttcacagtgttatttttttttccatgactttatctatatatcttcttgaaagttgatatattcatacgccgcagattaatgttacagaaggagttattgactttaggcaactgttgtaggaatcttattaacctgtttcatgatctggagtggagtaaagttagagtagatgcaagtgtatgacacattatggtgtggcttcgatgtacgtgggctgtgacagggttcatttttagttcatcttggtccagtgggccacccctattgggtcttaaaatctggatgagatcagacgttttataaagtaacatggcacatacacatgttgtcattggtcactttctctcttattttgttgtgaaaactttgctttggagattttggaatagggttgtttgacttttttggcagttagccattactaccacgataacttagaatgcggtatacagaaagaaaaaagacagcacctctcccacttgaagggttgtaaatttcacatggcttctttctcatccgaggataacatgatcttccataatttaaggtaaaaaggaacacattggcgatgatagtgttagccgaatcattgtaaagccattaatttgttggagatgcatcactcttaaccttcttgattcttaccctgtgcatgtatttcaaagatggaacatagcttacaaataacaacaagagtcactaactttaatatgtttgcctgcatttttagtggtaggaaaagcagctcactttctttcaaagttaacaatcactgcttaaaaaagaaaaaaatgtattcaatcagtaaaattgatacaacacaaaaagttgtttcctttaattttagaatatattgtacatatatagtatcatatataatgtcaaattttctatgtttaaatacattaattttattaaaaatgaaagaaatgcatgtaaaaaattgtgggcataataataaatactatctttagtcttattcatacaaaataagtgattatataaaatatattatcacttattttttataaataggactaaaggtataatgagataaaatcaaggttgttatgagcaatgtaattactattacacgggtgaaatgaccatttaaaggtcattttttagttaattattatttagaggttcgttttgaattattatcaaaaaagaaataaatcgtaatatatgttatgacttttgaattaaaaattgtaataaatattactgtttctacttaaaaaaaatacgactttaaaattataggaataattttttttaagtcgtaacgacttcaataatattaaatgtgactttgagttcaaaagtcatgttacaacttattttggagaaatttacaaaggcactcccactacagtcactattttggagatccaacagaacaccacactctggcaatcaaattccagcatgcttttgctgaaacaacccatctgcattctccaattgaaaacttcctggaacagtcacagtcacaatcacagccccagccaccacaaattttttgagacccagaaattaacttgggcgtgtgacattgtgaatgtgaacaacaacaatatgtatccatcatagcacataaagcatgcatgcagcatcaacattcaacattgacaacatgtatgagttatctaacttctaggtggctgactattactgatctacataaccaccaaatttatctccaaaagagtgcatatatatatatatataataaccaccaccagtattgtaacgccacattcactgatgaaacaacattataatgcttcgctcatgtacaattcaaaggaattgccaggcaggggagaaatttacacacatctcttcttatatgatgttagtgccacttcatctacagaatagacttctgataccaaaatcatgttaacggtaatttttaattaaataataatataaaactattttatattatcaatatatcaattactaacatgttcttatgtaattttgtatttaaaaattaaattattataaaatataataaacttaagcattaattatttatgctttaaatacaaacagtactcctgttgaatgtatagaaaaattatcaggtaaaaaataataattaaaagagaaacattaattttttaaaaatcaagtgatatatcattttaacaaaaatgatggagaatgaggttaaaaaacaagacaaataatttttgttttggttactaaggagggctgaagcccccattttttttaataaaaaatcttacgtgataggttgcaataaatataaaaccattccttggatgcactcaatatatgttggataacctggagtggatactcgagacctcttgggctggggatgaaatagtcgcagaagtagaggaataagtccaatttatatttactattttatattagaattagttttcttatatggcataaatatttataaattcaaataaaatacaagtaaaacctaaaaaatatttaaaatgatataaataatatttattaaaattaaaaaattaactaaaaaatttccatttattagcacacaaaaatttcaaacgttagaattactcctgtatatagttattattgtctttttttattttaaatttcgtaatatatttgttctcgaacaaaaatttaaccgtttgaacaaatattgcaagtctatattaatatatagtaagatgtattaaaaagaaaatactacaagaaaataagaaaagatcacacaaattgatttatcgtagttacctcatacttacacctataatcttgttacatgatctctagacaaaacttaaactctcccttcaaatgtttgtggccctttctccacttagagtggtgtctcagctccctcttaaggtttagtggatttttttatctcaataactcctattagatatgagaaaattttcttctcttaaatagttaaatttctttagaattttttttactctcatgtcttaatgtgactctatagtatattgattgatatagttcttagtgatttttattattgtattttgaaatagaattctatagttcttagtattgagtataactatcatttactactttggtcccgttgaaataatttgtcaaactctgtcattgatcacatttcttctcttctcgccaccaccttcacctaacctttctcccattctttttctagccatcactttcatctcctttattttttactttatgtgtttctctatgtaaccttctctttgactctatttttcccccatcacatttcttcctttcacctgaacttgttactaccatcttttgcaattgtatccaaactaaagttacttaggcaacacttccctactcaaatttgttgtttttttatgaggtcttctacagaacactactttactcaggttagttatgacttattttgggccaactcagtttgaattgttgttggacaagtgtcgttatataagaaataataaaacaaaagaaataagagtagaaaattttagactctattaaggtttgtttgtaatgggaggatgtgattatcatgcatgttttgttgtgttcatagtttgctaatatgtttatctatttagctttgagcgtgtttgatttgctaacgtatatttgttgtacacttctttagcatcctatatatactcttgtaagtgtctttggacattttcaactaatgatcatttggaaaaaaaaagaaaaagcagtggctattgtgagttgcatgtcatttgtccctttctaagctaacctttcacaagtatttgcacttaaaagagggttcaaggtgctaatcttgttacaaatattagttgagaggtattggcaaaggaatgcaaatttcaatctctaaattgatacaattaatctacccaaatgattttaggcatgctttaccttcttaccttatgggtggtgattgttattgtattatgtttaagaaacatgtgtggttgattgcccaagttattaacaatctctatcgagttaagtttgcatatattgcatgattgataattgttactttgttttgtatgtctatttatatcatgatattttaaaatgtgagatattgtgtatgctattagtataataatatatgaagtaaataataattttgatttctccctctttatatatatatatatataattatatgattttcttttaatgagctttcccttgtatgttttctttttgtttgaatgttttaacgagcttaatcttgtattctttaaagatatactattatgtagaaatcaaattgaggtcattctctacaatctcaaggtccacccattataagttgtttttagttttatttatttattattgactattgattgatacatgacatgtataaacaaatggtgtaacattcttatgctaaatatctctgtgttggaatttggaagtgttttcaattccgaacataaaaaatgaaaatggaattacccgatcgaatttgacatgctggcgcacacatcacggagaacataatttcaaatctgaaccgtcggttgattctgatcgcactttctgagcacttccttttgtgaaggaaaaggtgaaaacgaaaatggtaaagttttaaagatatttttgacgcacactacaccactcaaaaccctagtgacacccatttcataaaacgaagctcttcttcctttgtcactttcccggaaaatcctccccatttttcctggaaaatttatcttccgttttctctctgacaccaccgcacactcttcacaccttctctcactctgtactgtccttaccttactcttgctctttgcttcataagaatgtacctcaacaattatttattcattttttttttgtttacttccgtgtataatttgattcacggaccgttaatcagctacttcgagcttataattacaatccattttcattttttgtttattttattttccgcggtgcaattcgatttcgatttctggcttaattaaccgctttcggtgtttgcgttttttcgttgtttggcagaatcaaccatggcggacgaaggtgttgccaacggcggcggcgtcgacgatcagtacggcgaggaatcggcgactaagatcgaggcgttgcaacgcgagtgcgacgaattggtgagcgaaaacgtggcgaggaaagaggagatcaagaagctgacggcggagctcgacggattgaggagcgacggtgcagataaaagcgagaagatcgaagagctgcagagagaagtggcacagtcgcgtgatgctgcgaaagcaacggaggttatcgccgcgagggcggcggacctggagacggaggtggcgaggctgcaccacgatatggtatcagaaatgactgcggcggaggaggcgagggcggatgccgccgaattgaggaaggttttgggggagaaagagtctagggttgagtctctggaaaaggaattggcaggattgaagaaggtgaaggctgagagtgaggttagggttagggatttggagaggaaaattggagttttggagactaaggaaattgaggaaaggaacaagaggattaggtttgaggaggagaccagggataagattgatgaaaaggagagggaaattaagggttacagacagaaggttgaggaattggagaaggttgctgcagagaaaaaaactgaattggatgagtcggttaagcataaattgaggttggaggaggcacttagagaatctgaggagaaagtgactggtctggaattgagtattcttcaattgcgcaaggaagcaaaggaagctgagagggtgatcatatcgctgaatgagaaggcggtggagaccgttgagtcaatcgatagaggtttaaacagtgtacacggtgaagggaagggattgaagttgcagtggccagtggtggcagcagggtctacaggagctattgttgcagctgctgctgtaatctacgtgtgctatggaaaacggagctgattttctgtctcatcggagagtgatcaaggagcgaggggatttgaactgggggaggttctagaggttagacttaccaggtctttagtagtcatagatatgctgctgcaattttgtttgttacaaaataatgcttcttctctggcttttgtttctgaagcctgttgattttttgctcatgtcgaagttggcatactacttttttggttgttagttgcttattatgaggatcaaaccatcgtgtgttggatttaataaataggttgcaaaattgagattacttgtttctttgtgtttagtttgacccttgttagcttggaggataaacaatggcactgctgttagtttaaggcggcacttggtatcacctcttgtcaagctattctgtttctaaagttgatttctgcatccatgttcattttcacagcatggctttaaatatagaacccacctggtgaattaattgatgtttcaggattagatgatatcactgatttattgttgttgttgtaattgactttttgtcttgcaatgtggtcagagagagatgttttttcgggtcttgttcttttttttcttcccatgcttatatcccatttgtcgtaattgtattcagaagaatttgtatttggttgaatgtttttttcagttgtagttgtaggtggtgtgggtttggagtttgaaagcgttggcttgcattgcatccctttctttccaccttttaatagtttctgttaagttgactagtactgttaaccttttgctttaatttaaagagacacaagggtctatttcgtgaatttgtagatcaattgtcaaacaagtagtgtcgactgctgtgctaacgtttggatagtttctattaccaagctattgctgacataacttgatagatactaagctattgttttactgcttaggaggcgaaatttcgtgaagctgtagcatttttgttggaatttccaacttcaatttttattataatcgaatccacttaatgcgttaatgttgtttatacgcgaagaaagtctgtttatataaaatccccttaatctttaatttgattctgatgtgtaaaaatctcaactattgtacaatattggaaggacccggtgcgagctgcaaccctttatgattccctgccctataaaaatgaacaccaaattcaacaaaatgatttattatcggttagaaaaatggttcctgctttaaagagcttacgttttatcttgtttaaaattaaaggtgaaggctcaatcaagtaataacttgcttaaactttttttggtactacataataacttgcttaaatataaaatgaaattgatttttttcaaggcgaactaaaaagtcaatttcccaaaagaataaaaaagaaaaattagccactgtaagttgcatgatattcaggtagaaatagcttttgccgagcacacatgtagtatggcatctatttttgtagggtcattactcattaccagtgtcactcttgtaaaatcagagtgcatcagctttcatttaaaaataaattatccttaattttcagctttggatttgtaagactgtgtggtaagcaaaaagcgttgtagctacgcagtgtcagcctttaatttttgggcccaacacctggtaaggatagatcttatcaggaagagaacctttcacttgcacttcgtttagatggctgacaatagggaagaaaataaagagagaaacaagataaaattttcaattttgttgtttattcgagaggagaaatagatagatgtttctaagcgtttcacacactaaaaacttaatttaacagctaattttactaataatttttaattcaataatagcataacaatcagttaaaagtttctagctataaaaattaatttttcaacatctaactacttaactatttgaccaaatttaatagtaaagtttgttacaacttcaaagctattacagtatgggctatgttccatttctaaagctatgatcgaactttataggttatatttttgttgtgtatctagttgagatacataacggaaatatgcttccattacatatgccattaaaaaaaaacttaccccaaagctcgagtgagatgcgatgactgaagaggaaagggataggaagtggggaatggagaagaaggacaagtgtgacagaattgtgcaagagcaaaagagtttgagaaggagaggaatgaggtgttgggaagtaggggaaagaagtttaaaagagtttaggttatggagggattaaagagaataaaacatgagaacgtaaaaaagtcatgaataacgtaattttatgtattttaataaaaaaattaaatttttttaaccaatatcctaaaatactattagtgtttataaaaaaggagttaagaataacaatttctttttcttagatagtcatgctccaaacattcccttcctctctcaaccatcattaatggaatgtgctgatcgtcaaccaaacatgggacagcttaaatcatcctttgaatgtatcatttcaaagcaatggccctttttctttggtttttgcagttcatttgtttagccctttgcctttatgataaaatacatttatttttttgataaactatgataaaaggcatttctatctctatacagaagaagaatgaaatgacacatgagcttacttcgtatagatcataataacgtggtgaatgtaaaataacttttgataataaattctagttcatggaagtttacaatatgccacaactaaaatgtaccataccatacattttgtcatttttgaaatgaaacaatgtaaccaatctgattctgaaacgaagcaggaaagcaaaccagaacatgccccttaatttgaggctcaatgaatgcacgcaggacagattttgtctgaaagggcaccctcacagcctatgattgtgtaatgcctcagtaaccttagctcaaggttcaaccttctacgatgctctgccctataatattaaaaaatcaaataacgattcacaacttagaaaattgccccaaagcaaagctaattaattttgacagatgatcagatacttaaatttgactattgacaatcttcaggtcaagaagatcgaatcagttttactacaagtgttttcttaaagacaaatgctaaagtactgtattaaggacatttgttaagaaatttaaaataaaaatacttttattaaaaatgaaaaattatgttatttatatttttttttatgtttttctattatttatataataaatactttcttattttaatttttaaccaatattttaatagatcctttcttaaaatatcatctcagtatttagaaatttgacatgacttgggcttttgactcttgaggagcatcagtgattataacgcatatatcaatatcccttgaaataattgttgaaatcaataaaccacattagtacgttgctgccaaattgcacctaaagtactattgaatttgtctgtggtcactaaagatttcagaaccgaagtcttggccaaatatgtttaattactacgtagtatcggtataaaattattaattaatcataaattattattaatgtaatattttaaaaaattattataaaattaataaattattatatatgatattttgtaattgaataatagtataaaattattttagagtttccaccctcaatgcattcagtcaaaagtataagtgataaccaccaatgtaaccatattgacataaaatgcatgctagattgtattcatcaccattcatcagtaagcatgataaaatttcaggcaaatattttcaattcttttcttgtttagaggaggtactttcattactaatatgtgtaggtaattgatacacagttggactcgtacttctgttcaacactgacaattgaggctgcttcgcatcaagtttttatttgcataacagcttatcattctccttgcaatgtccaaataatttgaaaagccactaattaacgtcatattttgaagctaaggtaatcaaaacaattttctgatacttaaatcgaagcaattttaatccttgttttaccgacagtttgaaagggagttgtaaagttttgtttgagaaagcacaacagctctaaagcgttgttatttccatatcatactttttttttttttcaaacttaacaagacaaaaagcaataaaaagattctgatgccaactagagtattctctttagtggattacgcaaagtcttaaaataaggaaaatgtataatttgtttgccgagggtctccaagtcaaaccgtgaaatatttccattaggtttatatgttattatagtgacacttaatactacttcagacccaattaatatcctatcataattaagctatataccatttaggtatacaatttaattaaattctcattcaagaagttgtacaaagaaaataagtcactttcatgagctgaattaagtttcatattagccctttcaaatatttgattaatcagttatttatcatttattattggtcaaagaaagaataatccttggttgaggtttactcaccttgaattatctatcaccaccactcataatctcaaagagtccgcagcaactcttccaagaggtgttttccctttgagccacaggaacaattgtctgtcacaacaaaaagagtatgatcactacatccataaatgcatataaaattacaaagacaaaccttacaaccaacacttgcttagcacaaactgaaatgtctataggaaattatcataaagtgtgaatcacccaccggattttcagtgctttcagcatcaggaacacttggtgatggttgaaaagactccttggcactttcataggatgagtcttcttggccacctgatggttcctcaattttctcatccaatgttggctcaaaatccaatgatttctcaattatggttggagcaacctggtcactctcatctgattttagaacacttgtctccacagtttcctctgaagtcacatcagttagaggcaaagaagaatccccatagacttcatttggttcctcactatctctaagcaacttatctgtcacaactgaagacaaaacatttttttcctctccaccaaacatcatgtgcttaaatgtttcaaccacaacttcagtttctctctgtccctcatttcctgaaactgaaaagagctccttatttgtctctgaagaaggcaaatccgtttccttcacctcatcattaaccacagctagatcagatagaaaatctttcccttcctcatctttcaatgccaactctactgcatctgattccattgtattctcaacttgaccatctttcacagcatcaggctcaaacgtctcacaaactgattcagaaacatcttcttgtgtcacttcaactttgcctgagtcaaccagctccttattctcctcatttggtggtgcctcttcatcagtgatggaaatatcaccatcttgggaatcatcaacttcaacaaccacctccttatcttctctcaaagtctgtgtttctactttgtggctgtcttgtaatgttccattgagagatccttccattttcttgcagtggtttgctgaaacagctgcccctgcaggtaaaaagaatgacgctatattattctcttcaactaccacaaaataacaaacataatagccttggcaaatgggtgccaaactgccaatgaaccttattctaaaccagttttgtgttaatagttattgaatgaaaaacaagaaaattaacaaaaataagattaaggaaagtaacaataagaaacataggatacccaacaaggatgtacaaagaacagatggacataaagaaaaagaggacacgcaacaaaatgtaggtggccggggaaggtagatagagagtgtagtaaagagtgattaccttggagttgatcagagtgagaagaatggtggttgagaatggtcacagttttgtgtttcttggcttgttttggtttccttcttgaagctggaggcatggacgctgactggttgttccagagaatggtggatgaagattggtgttggtgtcaatgccaatggttatagacttatagcagtgtgtgtgtcagtatgtgacttccctttctttctttttctgcttcttctgtttacttatataaagaataagtgcttttaaattgaattgaaacgctcatggagggaactcaagtgatgatgaaacgttaaaaacagttccatctcaacttgaagtatattctgagtgtgcgtgtaacgatgtgtactatgtttggagtacaattttcatctaaagtaaaattccttcaagttgttttaaataaggtgatatatggattgttttgttaccttaaaattttaatttttaagagagtattagtacttttgtgtaccaataaaaataattatttatatattaaaatcacatcagaaattaattagcatttaatttcaatggtgttttaaattttataactacacatatttttcaaaatttcaaaatattaaacatgaaaaatgtactagtgtaaatggtatgggcaacaaagtaattcaaggcccgtttaacaattacaaaatatcaagatactaaacaataagtcatattatcaattccatattacctataggtaaaagttacaagtacaaattaatgtctattatttattggtctattcaagttatcaatatcctttaatatatgtaaacaccataaaattttccttaattttgttgttgtgattttccaaaatttattagatggtttaatttgttgtcttcggagtgaaacgttgcaaataaaaaatgcattgaaaatacgtgagaggttttaaaatcagcaaaaagaagctgtaatttataaagggttttttaagcaacaagcataaaaacaatcttattaaaatgtactaatcatataaagattttagtacttgtaacaacaatataattttttgtatattatctgcaattatgaaatgtcatgtataaaaaaactctagggcaaatggctaataataagtatctttttactattatattattagagttttatcaaaaagccgctctctatgggcacataaattggttgaaagatttgaaagagaacgttattttaggaggaatgatacctgttggtgatataaaatatatatggattttgtgagtaaataatcttggtcaaaaaatttgattaatcttcttgagtaagatatttttctctaaccacaagactaataagtgtataatctaaatatgcacactctataactacaaacaacgctcattttaatagtttttaaattctatttatctccttatcctgttagatataaatttacttctttatcttttaagctgtcaaatatggacaattgttcaatctaacaaaagaagtcgaagactgggatagaaggaccatgcggaattggtggtctttatgggccgatggttggcacctcctgtcggtgcttttcatcccattttaaaaaatgtttgataaaaatccataatgctatcttacacttagatgctgagttgaaaaagaaaaaaaaaagttttaaatataatagaatttatgacatgatagaaaaaaaaatgaaaaatattggtgaaatatttaaaatggattatgtatgtgtatcattattctatctattgaaagatattcaaagctaatcttctattttttttatagttgaggtgaacaaatataaagatcttctaactctatcgaaattgattttttttttaagtgggtattacctcttatatgcactcaaaacgatcattgacatgcgtaattaaggttaattacataaaccatattaaaaatgtatttaactttttaacagtagatgtcaacggttgattgagaaaaactacatatttctggatttaatagaatgaaatattttcacaaagtattgaacatttatacttttctaaaataataaaaaaattcttcagtgtacattataatcatgcatgcatggtttgcccatgcacataatgatcaagcaatcctttaatgggaagtcacaagtgtttattctttcggcaatcatatggaaaaccatgagcaaaacgtatgaaatcgcggcaatagtcgtaaacaaccaatcttgaatggatctctttgaggtgcttcctgatttgagcatcaagaccttcgtttcttccaccattgaaacccatgcaagatgaggtccctggtccagcaatgcacgcattcgcattgaaatttctgaaacctgctatgaatggagctttagaccaatcaatcttaaccttcccccctcttgttgcccaaaagtctccattccatatagttgcataaatcttcattggttgacttgtggggaatggaacaccgatgctctgcctgttgtgcatcactctgatgggtgtgttatccaccaagattctacaaacacacaaaaaagctcatttatgctatattgtacccataagtagaattatacaaatttattttgttccttacattattgaatgagttgtaatttcacaagcaatctaaaaggtttttttaactgtcattcaagtataaatattatatatttatatatgataaatttattaacttttataataattatcaagtaatattaacaatgatttctgattgatggatagaataaaagttttttacatatacaacatgtatctccagaaaaaaattattaagtatgtggttctagatcattatgttttcaattatttttacattatatgtatattaagtgttataaattaaataacttaaatacatgttacatataaagattggcaccataaacacgtctgctaataattttttgcatcttgaaatttaattagtctatgactaggccatataaatgaattggatgtctatgtataaaaaaaactttataacgacgagtgcatataaattaaattcttaattttatacataaatttattttgtacttacattatgcgctgagtgttccaatcaatggagtaggtgtggaagtcctgtgtaggatcaaaccaaagatagaactgcatctcacgacccccagtaccgttggcataataattggttgagagaatgtatggatcaccagataagttgcccaagaactctaaatcaatctcatcatggtttggcccttgagagcttagctgcatatatatatgaaaaagtaatatgcatgaatattatgcaatatattatgtagtatatgtggatgttgtaatgtgtttacgtgtgtgtgcatgcatggatgggagagaataagcaagtgaatgattggttaacttggaacaagttagtcatacataaaatgtagtgacagtgcctgcagaatttcctggtataagcttgatttgcatgtcaaatcgtccaaacaagtactccttcttggttgctatgcccgagccagaagatttgtccattgcaagggacatgcttgagcctccatcttgtatgttagctcgattatctccaaagagaatgttaaaatcagtgttgaaattcccacccaaagcaattgttgttgaggctaagaagctgagagaaagcatgaataaaacatatgaagaagccatgttaatttgattatctgaaaaaatatgaatccactaaggtatttaaagtgatgttgcattctcgaattgagatgttaatagtaaaatgcagtggattcatatcaatttagctgtcaaaggtggttgtggtaactgcctcaagcgcaatattgctgtcacaattacaggtcaaaatcttgaagaaccgaataaaatgttttttaatcacaaaattaaagttctgattggaggagaattggttttgatgcatagatatctgtggacacaattttaagttgaacacaagtcaaagcccaaaataagttaacactaaaaaatgtagtctatatatgggctggaccatgaagagccaaagaaaaatagttttcaatggcaaaaaggtctgattggaggaagttggttttgatggcaatttttatttttgggctttacatggccgcgtcttgacaaaattacataaatcaaaagcccaaaagaagttaatactaaaaaatgtagtatggactggaccttcattacacccttcgaaacatgcaacggaatagattaaaattaaactataagttgtaatattaaaagttgaaatcttaaaaaatatcattataaagagactttttattttattccccattaaatacatcttccacggaagacaattatgtttgaacaagtagaattattatgctcgagtcaaataaaattattatagatataaaaattcttctttcaattatttaacacaattatatatttaagatatgaacttgagatctataattaaactgaattttttttagataagttgatccacatgtttgatgatgaaaaaattaattaattaaatattagaaaaatgatttaaaaaaataatatttaacacaattacatatttaagattaaactgaattttttttaaaatcagttgatccacatatttgatgatgaaaaaaattaattaattaattaaagaaataaataatactagtcaactagtatgaaaattgcggaaaagtattgagtatggtacacgcaaacaaaactacgttagtacgtggtgctggcggctgagtgtgcgctaaatttagcgccccttggctcgatgacttgaaggtaggaaaatcaattttgtacgctatttttttattttattttgtattttatctgtattaattttttttttttttttactttataaagaaaaaaactctgctcaagagtttctgcatgtgcagcaagatggtcacacacactcacaccaaaggctctctcttggtatagaagttgaacaaaattctagaaattggagtaatagaatgtaaataattgagggtgcaaatatatatcacgatcaagtagttattgtgcagtgctagctgtcaaatagtgatgatggtggtgagctaggtgcccccagtgggtggcaattcagacagaccatcttaacttcttcacgttcacaacagagcactctgccacatatcagtgccgtgcaatgcatatagtcaaaactgtatcagaaaactcgtgtagctaagtcttcctccccagacccacacaagtagtaatatcagttggtacatttccgatccatatatttacatctgtgtagtattatgtgaccctggatctcatccagcaaacaaaaagtacgtttcttctaaaattgatgtttgaagggttatatatattccaaaatggtaagtcatgagattaattcttaagacataaagattattgaaataaattatgtttctcccataaaagtctttttcataagtaaggtagaataagaacaatataataattctttcaggcatattctataaaatagtcataattcctttggtcacgtgtagtatagtttatttggattttttgaagtgttaaccggattcaagacttcttaatagtgagtatatatgttttcaatctcgagcttgaccatgttgtggatcatcaaatgtatgtgtctttcaagcttaacttcaagggattgtgaagtgttcgattgtgaatcatacagcttaataagcatatgtgcttttaagacgattgagtgattctcaattgtccaattgaagatggatggacatctaatccttggacccaatataatggcaagagtcaacacaaaatacaccctataaataggcatggctcgtatttgatcatatgagataacgcatagtagagctcatttgaatttcttgagttattaattggatttacgactcgggcaaaaaaaattaatattttgtttttaaaaaaaaaaaattacatattgtagtttcaaagttatttacgcatctataacaacgagttgcgccctcatcggatgcgacttccctagttgtgacacgtgtcattttgaaacatatgatattttgaggcgcaatgtatataaatttcaaacgattataatttttgatagaaatgtccgattgagacgtaatttgtgtcaaaatgctcaaaattgagataggaatggctcggaagatccatggtcaacctttttttttttcatcaaaaaatgtctttaagtacctcaaatttaggatttaggattcaatcatccaaaaatttcctttttgtctacttttttaattatttaattagttaatttaatgctattttctattttttaattacttctcttatttcgagcgttttgacataaagtacatctccatcggacattcctataaaaaattatgaccgttcgaagtttgtatatacaaaaatagttagaccatttgaagtacgatattcaaaaatagcactagtacgatttttttccccaatagggacatatttttctttatttaccaaatgggggcagggtagtcaacaaaaaaattaccacgtggcacaagtcctttttttttttggaaaaaatattggtcactaaaatttaatcgctaattttggtctctatttcagtcgctaaaagtgttagcgaccaaaataacgacggaatgagtcacacctggtggagggcacgacttgacccctgttgcacctggtggggcacgactcattgctatagatgcgtaaataactttgaaattacagtaaatctgtaattttttttaaaaaagcaatattttaatttttccccccaatgagtatgttatcataaagttgtgttaacaacatttatatcagaatctgaaacttttcaaagaaatgagtacaagcacattttatattttatctaaagataggaagctaaataaaaatagggtcaattctttaaattttttttttttacataaattatttatacttttaatttatataaagtttctcccattataaaatatatttttttatatttttatttttattttttcattatttatgttattctaatataaaaaaaaatcaattaaaaatttaataatgtttacttttaatagtttcaaatagtgctaccttataaatagaagattttatgtaattagtcaaaatatgtaagaagggtgttcttgttatttaaaaataaaggttttaaatttatgtgtatcatattccttgggtcatgttattttctccttctctgctgatataggattttgttttgttgtcatggatgaattgtgggccaactaaattggtgtgcagattgtttggaggagaaggaaatcaagtggctgattgtttagctaagcttggtttgtccttagataaacagctatgaatttttgaaattattcctctatttttatcaactgtagttttgacagatgtatcctctaccacgttttcttgtgatttttaatggattgttcttaggggtctccccttccattcaccaaaaaaaaaaatggagagaatttgtgtaggttttaattacatagaaaaaatgtctaaaaaatgtaaaatagaaaggaagttcgaacagtttacgtaaaaaataatataatatttttatatgtaaaataaaaatataaaagtattttcttaaaccaaacaattcgttaaaaaggtttaattttaagcttttttgctttggttctcagtgattaggtgatcacaaatgatatgcctgatatgtttgttctatcatactttgacctccagtgcatccgttttctcttctcagtggtgttttgatatttaatacttgatgatggtgacaggtgaggaagctagagacttcatttctaaatagtaaacgtgttatcttttgaaatacaccattatatatgttcatgtttggtatgcattcatactatatgtgaaagaccatgtgagtttgtctattataaataccgtcctagcttgtaacgtataacgtagtatatatcatatagtaatgattaatgaatgaacgtgcccacttcattaatttccatcttcatccttgtgtaattaaacatcagacggttctaaaagattaagaatttgataaattaaaagaagcataacaaatcacgtctttcatcagttactacttttcgcaattatttcatgtcagccatttactttggaaatgctgaaatgtacgtaacaccaatatcttttctggagttgtgatcttcaatggatttgtttcccaaacattctttttaactagtatattccaaagatgctgttcatgtgcatcttttataatatgttctgaatttccttcgaaatctagtcgaaaactggatccatacccaagtaaataacatgtgcaaacgcctcaattcagggacagcatacgataggaaacaaaataatattaattattgtcttattggtaatgtgtgttccaagagtacaatatttttatatgtaaaacaaattcattttgaggttgtatgatcatgtatacttgggagaaattctaatgggcattccaagggaagggaaaggcaaaggatccattgcgactggctcatctgggtggagtaagaaccactcatattgggtcacaacgtagtgcacaaatatgaggatatttaacttagctagtaggtaccctgcacacactcttggccctcctccaaagggaacaaatgcatattggggtattccgatccctcctcaaacctacttgggttgaaactcgtaggatccttaaaatactcttcattgtaatgtgtcccgtatgttgtccatagcacctgagaagagccacaagaaaccccatgttacatgatttaattcaaaattgacaaattatgagatatgcatgcatggatttaagaaggaaacaagaaagtagtattcaccttccatcctctaggtataatgaatccttcatattcaatatcagtaatagccttcctgaaagaaccaaagattggaggaaacaatctcatgctttctctagcaacttgccaggtatacttcatcttctttatgtcctccattgtgagattctcaacccatcttttgttgctcattatagcaacatgttctgcataaagtaagtacttcaaactatcaactatcaactatcaactctaaatacttttggataatttaaagaggaaatagtctatacacttacattatgaaaagttttagaatatcaattaattataatttgatatatatggtaagcttttttttagaatatcaatcggtgccctatctttcggcatgatagagtcccttcccatgagcttaactgaggaagaaggccaagagattttcaccaacttgaactcattagacaacaagaatttattggcctgagctccattcacaaccacagttggagaccccatgctccttgttctgaaaatcttctcatgcttcagaatgcgaggatgaacaaactcttcaaacaattggtttctcctttgagcattgaagaattccatggtctcccctatcaatggaaaccccatttcccctggggggagctttcttttgtctttgtagcattgcttatgtctcaagaaattgaaagagactagcaaaagtagtaggggaaacaaaccccacaaaataaaatagataatatccccaaatattggtgaacttgtaaggatcaaggacttggaaaaatttaagctcatatctataaattgttttaagattgaaatgttggttcagcacatttttataggaacctgtggtttgtggaagaagatgaatgaagtcaaacccaaatgaattttacgattattataatcttgatcatcctagaagtcaattccttcctaataaatttctaatttgtgacagaaacaaaaaaaagaagaaaaaataatactgtagcaccacagcttgtgaaaagaatactgtaggattcttttctgtaatagattcattgtccgaaaagaatgacacgtaatcatcattaatatacctgagaaattcatgatgcaaaataaaaataatttttctcttcatggtcaacgctagaagctttttagttacccaagaatccttaaaaatctggtgaagtctcgttgttttatcatgtgactttggatcatgtttcagtcatcatgattgctcattattgcagcaatgtaaatactgattggtgtctgatggcgcagaatcaccgtctctgaatctcaactttaaaatatcttcttaaagtaattacaaaggtaggctgataatgttggagataatgttgtttgtaaccgcctaagcacagtcgttgaacattctaaacaaagttttcggagcatggcgataaattaaatcagcatcgtttacatgcatgttagaaagcaggattttgtgaatttattgcttgttgggggatgtttagcatagaaggttcatcatttcatatgtcaaaggaactctataaacaagctgtgaatgaattgtatacagttgcttttttacaagaaatattatgattacaaaaataacaagatttgtatttgctcaatgtcaccaaattttgactcgttgttagattattaccatatcaatcatcgggccaagattaacaaattggttacaccttttgattaggtgtttaagaggtatggattgtctaactgagattaataaattgcctgtctttcatgtttagcatacgagggattgtaaattgtttaaccaaaattaacatttgtctatgccttttagatttagcgcttgagagattgtgtattcttcagccgagactgaggccacacatggccaattgactaagcattcaacatgcctttaaacagattaataagataaatcaggctttcaaagggataaaaaataaacctataataaataatatactaggcttaggctttggatcttttaaacagatcaaatctatccgaccatcaataattgacacaagtggtggtaatagtttacgttaatcaaattatttagggatcaaattccaatattagatatgaaatacaccatgctggaaagagaatatctatgttacgtgtgcttagtccccaacaaaatttagtcactattttttatagtggatattttgtttcaataccatggtaaagcaaaaaaaaaaaaagccttgttcaccctaacctatttctactctaacaatgatcaaccacgacttttttgagagaattacctctattattattccatatgatttcactaaacattagtataattttgctgtagttaaaatagaagtaaacctggcttttgtcgtggaaccttgcctatgctggctccatagcaactacattcataaaccaaatttcactctttaacaactcgtctattttggtaagtaaataaaagaaacttattaacaacgctatggtccttccaatctggtataataagctcgtcgattctatcacagccatatggtgcaccgaaacatattgccaactattgagactgaggacttcgaaggaagcaacaacttttatgtcaggagggaagcttcctatagacataattgttagcatgtgatagactcagagacgttagacggttgcattcaatacagccaagacttaattatcaaaacttatgcagattagacgatcgaaagcattatcttttgaacaataaaaaaaatacgaaaagaaaaaatgtgataaggtagttaatgtgaagaaaaaagatggagaaaatagtgtttacttccaatccttaggtgaaatattcaaggtataatttgaattcttcaatggtcttttacgaattaaactctagggtaattacttgtaagactctaccagagtactactactatccaagacaatgtatgtcatagatggtgaagtaaattagaatttgagtgtgaatattttgggcttacacttatatggctctcttcaagctaggacgataattctcatgcaagataatgtgacgaacgcttaatcccacaattcgggggtgttcattgctaacagttttatgtcatatgtctcagcatttcacgttcgtatgagctcttgactcttgtgtaacattaggaagtggtgaggaacattaaacattgttgagtagtgatgaattgtacttctatagtttttgggtcaacatgtctacctaatcaaatagaccaagatgggtcgagaacagtccagatcaaataatattatacaaaatattctaaatacaatgttacagtataaaataacattactttttttgtgcacatgtaaatttattattataaacataatttaataatgattattccgttaataattaacataatggatacctatggccttgttatttattagtcatcttccagcttcacttcaccccgagatttgcccaacacctgtaaccaatatttcaggaattattaattgtttagaagggtggtccttcaccaatgtaaaatgagttatttctgataaatttatgcaaaaaacagaaaacacctttcttctacatttttttggacttgaatccactagtatgttggatttaaatttagttaaatattttgcttgatatgtttcataattagcatataaaataatactattaattaattaaaatgtagataatgaatttgaaaacgagtgtctacctatacataaaatataagaataatgaatactagcattgctacctatataaaaatgaattggagatgaataattttctaaaatacagatatatgaacatattttatatataaccgtaatcaataattagacataagtgattaatatgctgaaattaaggttaattcatttgggtaatatttaaattggatcatttataaaaataattattaatcaaattttatttaccttccaatcgaacttcaaattagtcaagattctttctttttccttggtaaatcaaagtgttaagaaaaaaaaaaatatcaccatacaaatgaaaagcattctctcctgaaattcatatagaaaggtttatgtgtcatgaatatttatttatttcaaacagagaaggtgctccttccaaagtccaaaatgtatgtttaccaaggcagtaggcacacaaaatctaaattgaaactccagcaaatgaaaaggtgttgaaacctatgaaacactaactcggacatggagatagatataacacggacacattaaaatctaaaacataggatatgggtacacaatattaagtgtctattgatttttaaattttttgattaaaaataaaattagagaagtatatgtgatttgtccagattagtatttggtaagtggtaactaaattaacaaatctaacacgatataaaattatcaatattagatcccgagaaaacgttgtcctcaactggttcacccaatgcatagctcaagggccagttagtgtacgctcctctgtttatggccgaaatttttttattatgtatttggcaattttttagttttttttaaactttacatataaaatcaattttaaatataaatgtcataaagtagtaggacaacgtgatactaaaccctaagaaacatgaaaagagaaaaatccaaatccttatttatgtcctattgatgaagaacaatatacaaatccaagctttaacgatgaactcagaaatgtccctcccgaagcacctgtcccaaaacagtcacaatccatgaaaagttcacaactccattgatgagagactttccagttcctacttccaaaaccatgggtaacaatagcaattcacttccttacaaacaaatagacaacagctttgtcttttctatttagtccataggccacagctcacaggctcacagccaacttgttttcctccagtcctatacattacagtgtgcacacacatttatgtatttatatcagcaaatatttaagtatatgtttggataaatttttctattaacatttatagtaaaaaatgtaaaatgtattaattaaacttctctataaatttaaattaatttatacacctttattttttattttatttttcgcttttgagggtgaaaaactagatgttattcggtagtagaaactgaatgatttgtgtatgtttagattaaaatttgaaaaattaagtttggattaaactttagtttacaaaagtatctcaaatattattttttttacaactgagtttcaagacaaaattttagtctcaaatatatttttggagattaactaaacataattttaaactcattttcctcttaaacatacttttaaccctcccaccggaaatccaaacacacccagccttagcctttgtagacacaaaatgttccacttggaagggaatttcatctatccagtatttctcatgcaaatcaaaagctaaagatgctaattcatggcaactctattgctaaacaatctgttataattccatgaaaggagttgctataaatacttctaaaaaatttagtaaacagagtatacgtaaacaaatttgtaatatacaaattcaaaatcgatgctcgagtagtatcaaaatgtgaggacagcttgtaatcttaccggcaaaaaaatggggggaaacaccactcgtatccactattctcccaacattttttttagtaaactcacctaccctctgccattgtcatttagttcggaatgactcacacttgtaatcttcgacattagggtcccttctctctctctctctctctctcttcaacagccttagttcaatatattttttcatgcaaaatgattattacaaaaatattgaaaaattattcctggggcacgtctccattagccccaataaatgaatcgggtgctggagatttctctgtcaagtagtatttgatttgatttattgaaggttaaataaatgtataactcactaagcttacagaatataaactggtttacgcctgtaattaataccataataagacaaatgcaacactcaaagctaatgagtaatttcagtacaatccagctcaagcttatgattaacaagaaacaaaggccagagttaggagagtgcgttctgtgttttaaagctattttagaaaactcaggcattattgcatgaagtagtagtaaatacggagtaaatgctcctgcaaaacatcaactaacccgcatactcctccacctgctaatatttactccactctgtgaatcattttatatattcttcccagtccactcccctctccaaactcaaacccccccttctcttctttctcatagtgttctaagcagtcagtgacaatggaaaggaaaagacacagtcctatttctatcactatgttcacattgctacttggagtgctttctcagaaccttgtcatccctgtagtatctacccctgccatcattgtggaccagaagaactacaactctccagacccacatgcaggaacagatttatcaaattctctatgtaattctcttactcaactatacattttgcttcattatttatgcaaaatagaagatatcatttccttgctagctacagtaggccatttactttcaaatttgaagtacgaaggatcaatagctcttaaagaaactatcttgacatttaactttaaaatctaatagtatacgttgcttttacttcttgaaggttcatactgctctccagatcatggttctgggagtggtgggcacggaagctcaccacaccactctcatcatggaacaccctctcatcatggatctccatcacatggaggtggtggaagtcacaatccaaccccatcaactcccccaggtggtggaagctatgatccaactccatcaccaccctcaagtggtggtggaagttacaatccaaccccatcaactcccccaggtggtggaagctatgatccaactccatcaccaccctctagtggtggtggaagttacaatccaaccccatcaactcctccaggtggtggaagctatgatccaactccatcatcaccaccctcaggtggtggcggaagttacaatccaactccatcaactcctccaattggtggaagctatgatccaactccatcaccaccctcaggtggtggtggaagttacaatccaactccctcaactccccctggtggtggaagctataatccaaccccatcaccacccacagatggtggaagttacaacccaaccccatcaccaccctcaggcagcaactgtggcacaccaccacatgacccctctactccaacaccctcagtcccaacaacaccatcaaccccatcaacaccatcaaaccctccctcaggaggaggtgggtactataactcaccaccaacttatggaggtagtagccccccaacaccaatcactgtgagcccaccttcaaccccaattgaccccggcaccccttctatcccctccacacccccttaccttccttccccaactcccttcactggtacatgcaagtaagttcctacttcttttcactacattgcactataaactatgatatgatattcagccacactgttaagtaacctatgggaccttgtcctctaaattgcagctactggaacactcacccaggaatcatttggggattgctaggctggtggggaaccttaggccatgcatttggtgtctctagtatgccaggatttggtgccagtctcagcttgccacaagcactttccaacactagaactgatgggctaggagcactctacagagaagggacagcttcctttcttaattccttggtgaacaacaggttcccttatacaacccagcaagtcagagacagatttatagcatctcttgcctcaaataaggtagcagcagcacaagccaacctcttcaagatggctaatgaggggcgaatgaagcctcgagcatgacatagttaatttggtttgtgtgtcagtttatttagttaagaatattatgtctaagacttcttctaagagtgtgttatttaggcttttatcttgtgtaatatggatatcgttttactttacaagttcatgttagcctttatggtttcttattctgtaataaagtttatatattgttacttcaatagttcaattatatctgcatccgaaagtacaaacttcttttcattatatatgaaaaaatgcaaaattcttgttaagataaacttatttcattatataaaaatcacttcaactcagctaaaatggaaggcaaaatcagaatctgtgatataattcatcaaataaaaactgaggattggtataagtacagcactaaaagggtgcatcatcttctcattaatgaaggtccacctataaggatgtacataatctgtcaaaagaaattgattacccatgaagtgtaatttagaaatagccctagtctagagatgtcgattgttcatgcaacatgattgcattcaagagataagaatgatatggtgagtcttgaaaacgtgaacaaggtacaaactgtaaagaatgaagttgtctagaattgtttcctactgaaaattcaagggaacggttttgttgccaatatatatgcaaacaaagacaatagatggaccaagatgctggcaatggtgcccctatgtgaattggaaatgatgggttacagtggcacaggaaggattaaagcgccatgtgagctccaattaatgtcttttaaagtgcctcaaggggaagtgtacaaggctgtggtatggtccagaacaattacaccggatggtaaagactataaaaggagggtagtcttcccagtgtaatgtaaaaagattcattatatctttaaaacacaaacacatataaaacccaaaacgcgtcttcaacttaccaaatacttttgagcaagataataactgagatattaaagacctctactagtttggtcttcccagtgtaatgtaaaaagattcattatatctttaaaacacaaacacaaataaaacccaaaacgcgtcttcaacttaccaaatacttttgagcaacataataactgagatattaaagacctctactactttagtgtacttcgtagctagaaagttatattgctttgctatatataatatatttacttgtgttaatggtaaggaataaaacgaagaacatggatcaaattctttgtgatttaaaaagaaagtatttttttaattcaaaatatgtttgaaaaaattatgttaattagataagttttttggaggaaaaaaaaaaaaaagtaaaagcctcaaagaaaaagttgggttgtgcttttctttttcacaagtaaaaattaataaattctagataaaaaaactataagaaaattatatgtaaaagcatttattttagtttatccgaaagaacccaaaacttttaattttaagaattccaatgtgtatataacttttaagctccaaaagcttttgaatgcttaagatgacaaacaagaggaatatgaagtcatccatatgtccaaggtagtcaaattgagatcccacctaggattggaaaggaggggaacatgtatattgtaagatcctaacaaggatagtaagatctcacataaaatacaatatacaatatacaatgtttccaccccacatcacttccattttcaggagcattcttgtgcttagaacctccacttgcagggacaaaaacagcaccatataattacaagaatttggatgtttattggtagaaaggaagaaagatctcaaaatactatagtttagatgtttactgatagaaaggaagaaagttcccacttcccattcataattacagtagaagtgagtggaattacaagttcattgttcccatggtgccctcatatcaaacacattaaatcttaggatgaaaggcaaaaaagataatttcaaaagttattccatccactcccctgtcaatttgaagggaatagagaggtgtggagtggaaaggagtctccttgattccattccttttcctttctaaacatccaaagaatggcatcttttactatctcatataatttttctcctttccacctctcaccatcaatacaagcaaagggtaaaaacccaaggaaaattgtatgcatttaattaaaatactgtcataattcttcaccttgaaaattagaagccctcatctaaaacttgcttcaattttattcatttcagttcttatttaaaaattatgtttgcatttcttattttaaattttattcaagtatagatgtcaaattgggtttagatcatagggcaaataagtctagtagtcaaacttgcaggatcaggctcataatttaatagccatattaaaaagtgtattttgaaactcaagtccaccagggtattcaaatttcaaagattaaacaatgatttgtgtttcaaatctcaagaaaacggtagaaagattacaattttaacaaaatttaggataacattcagcatactgcttgccaaagcacatatggtattggtgcaaaggttcagaggcataccttttacatagataacttctgacagtaacacccaattaagaaattccagcccttgagactcaatctctgataaagaaaccactatagcagtttttacatgagtcaatggatttcaaattgaatttcaggaaaattgagtcgaaggttaggtccatcatatacaagtggtttcaatgcaggtaagttttgatgagctcatgtgagattcaaaccatttaaaaatttggtcagaatgcacactagtcatctcatggtaagcaaatgcaaggtttagctcctcttggatgtgagggaccagattcttatccagcagaagagctttcttctcctcaagagcctttttccatttgatttgacgcccatctttcctcatataaccatttttatcaataaagcccttttcctgaaagaactcaaataaatttctggaaagagcctgatcaagccctggaactctatcagctaaagtacttggtgacaatggaaactccatacattcaacaacaccaacatcaatccctttatcttttaaaacctccacatacttatctattttctgctgcctataaagatctttgggcatgtgaacaaaaagggtcggcgggtagtcccctttaacatcaatttgctcaaacatcccctcagcaatcatgagcacagtactactaaacttcatggcggtggcaagcacagacacgaaataccctccagaagaagcacccaaagccacaacaggaagcttctcaagcttccttctaccaatccaccactctataatgtccttaacaaccaacacttctttaccaaatgtccaacatctttgtgcacttgaaatagtaataacagcaaaaccatgggcaagaccatggagtacaagcaaccgttcctcaggcaaaccaatgcaatgagggcattcagcggacttgtcccagaagttgattgccctgccattgcatccatgagccagaaagagaacacctttaggtgattcaggcacttgccatatcaaatcagttccattccggaactcttttgttggatgcaaatgcaccaaagagtcaaagctattccatttttgtttaggaagttcataagctaaactgggattagcaccatcactgtcataacgaaatactaaaaggaaaaccactaacattagaatcaatgtaaaaaacatgaggaacacagaaacccggcaattctgagctccactccatggctttggtttgtatccacgcttcaacatgctgcaagaagggttgatagaaagcgtagaaaagatcaaaattttaccaaaaactttcttgagagaagattggtaaaccatgaagggtcgatagcgttaaatcaaatgcatcattcaaatcagaaggagattacctacggtgttgaatctccaaaatcgacactacctctgaagtgttgagctgaatctctaggtacaaggataatccattggatgaaacactgaaatgttctgtgcggtaaacgatttgcagttttgcactttagtcggttgctggattactgtcatttgggatctgttgttttcacctctttttttgctaagttcatcccttaccttcttcataatttttgaacattaacgcctgatttttttccgaatgacacacaatatcccaccttaacgatttcaaatattattgggaatttgtgtaatacaataggcgtattagtataatgttttctaaggatattattgtaacaagagaaaaaagaattatgttatgtgtaattcgaaaaaagaatatcacaagacactggtgtaatttgcttctttgtatatataaatacttttgacaaacttatttccattttgcatacaaaaactattgcatataaattaacatgtgttaaatttatattaaaaagtcaactaaatatgtatatttagtttaatgtcctagtctattagaagcggaaatccctgaatttatagaatttctgcctaagatcatggctgtaaattaagctatattcaatttaaatgtgactttaattcatcttttattttgaaataagagtgaatactattattctaccaatataaattaattatattttggtttcatgaatgtatgtccacagtgagtttgacctgtccacagtggcattttgtgatttaatgtgtacgtcaactcctactcaccaatctcatcttcttgagcaaggtatgcacaaggaacatcaagtaacttgaatgtatgtccatagtgagtttgacctgtccacagtagcatggaatttttttattaatttaattaataaaaatacatataattttttttgaatacaaacatatcatataaacatcaagattctcaagtcataaaacattaaagtatctgtgctgcaagttaactttcggcagaaatcatttgttttttgccctatatttgctaattctatgacattcaacaagccagacctttggatttaattctaatatgcaatgacattattttttttttttttggtaaattaagaaaaaaaattagacaaatatataaaaacaaaaacaattgtttatttcattaaaaacattctttttacaaaataaatttaaataaacgagctcacaatatatattcccaccgatattcttattacaagcttgatcctgctgttttcagtattttgttaggagacaagcaaattatattgtacatcttctaggaaagacatcgcaatttcatnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaaaaaaaaaaaaaaaaaaaaaacttgatcctaatgaagaagcattcttattcttgttgatacgatttgtgacgcacgttccatcttgggtcccagcccgcacctttcagactcatattgggctaacaacagaacagggagcacttaactatttactgggccaattgtgggcccattcagaagcaccaaagacaacaaacatcaaccatgtgcatttgcatgcttggttccttcagccaccttcacctttgctccataaatttagcttttgactttgggcattccatcacgttcctccttttcacatttctcctttgtaaagcagattccatattggtttcaatatgcttaatcatgttatattttttttttcttcctttcaattatattctactttttgtttaactcgttacccattttaaaattttaggatttcatggcgcttatgcgtctttactctttagtaatttctttaataatttgttgttagatgtattttgtgacatatgaatacgttgattttggaaccatgcaagtttttaagctcactcttgtattaaaattcaatagactcttcagttagagtcactctttcacacaaaataattctttcaaattaaagtttaaacagaataaggtaaaaacatatttattgtcttattaattattatacttgagcaaattcattttcaagattcacatgttagagttacaattagcttttgaaagaaacaaaacgatggcaataaaactcttttttggagtatataacacacacacatatatatatatatatatatatataaaagattgttaagatgcatgtttatcaaatctttagtatgaattttgagttcaagatttaatttttactaaatttttcaataaaaaatatggacaaatctctaatatgaaaaatggattcttgataaattttgaagatctgtgtaatattaaaaaataataatttgtttttctttccttctcttaagatttcaaaataagatctaccactaaaaaaataaatgaaagagattttgatttaattctatgtaacactataggatcaactaaaaaatggtttaagattctaatttagaatttttcattaaagatgttcttatatcctcctagtgtatgtattagcaatttataaaaaatgtgaaggaccaaaaaaccactaatttaatattttaatttatttattttaaggatgttaccgtaatctgatttaaaaaaaataaaaataaaaaagagtatgatttctctctcgcctttaatgtctttcgttccgatgcattttgtctttgcatcttctctcagaagtacatccgacaactcagaattgcaacagcaggccaacaactatacctagattattagcctacgacaaacaactatacctagatgatcaatataataagttcgttagtcatcatatatataaaagtcacgcacaattaatttttaatttttaaaaagattgttgcaatgcattttctctttcttgttatgttttgcacatatattctctcagcagtacatgccacaacccggaattgcaacagcaggccaaccacaacggctctaactcagtgatttacatcgtcgctagctatgatttcctcgcggatcatgatgatccttctctactgtgtttctgcggacgcgctagtgcaatgacccgaacaccaatgttgtttatccctcatcacccaatacctcctgaatacttctgaacctcaaagcataagcaacctgaaaatttacaagaatagctagaattgcacccacctagcttgatcacaagggaattataacttttctttgcctattcatttttagtaactaaagtgaaatgtcgaccaaacttgtaaggctggaaataaattttttgttgtaaattcaatatataaataatgtgtgattcacatgcgatcaaaatagacacatatatgcatgcgaggttcaagtattattattaatttctcctatacaattatatttagaagccaatatagtcgaaattgacaaaaacacacccacacagaatgtaaaaatgttgtctaaagttaatttagagataaaaacagagttatatcgaatcctattaaatatgtatatcataaaatagaatttaattaggcgaagagtcaaaaggctcacactatcactgcaagctaaaaaaaatgtctaatgagtcattaaaatggtgacataacatatataacatgaagtgatagctcaacagtcaagaagtgtacgtagatatatataggtgaaaaaagacagcatatgtttcatatggactggagattaaagtggtaaggactgaatttaatgttaatagtgaatatgacataaagatataatactacattgaatgaaaataatatctctctctcacaaacgaaaaaggacggacttaaaagtttaaattaattttaatttattgattatttattgtccaaatccacaattgcgcaatttttttttttttgccacaagaacatttttcattattgaaaaaaaaaaaactgaatatatgtacagccacaacatccttatccatttcattgtataatgactcaaggtagctagctagcgtgagtgccatatttcacgtccatattatcctgaatcaacgtgcccatagtgggctttgtgtgatataattcaagaatgattaatggggtgctgattttccatattcataagaaaattgtctatacattattatttaattactgatgaccaaagataatagatagcatatttttttcaaaaaatattaattgctaatttattgatttttttttacagggaaaattaaacttaagacatatttattttttattttttcttaaccactcaactcatctatgtgcttgctccaattctgcatcaagaatcaaccgtttgaatatataggagaaattaaggtcagacaatcatgtcgtagtcctttgtgcatatactgttcctgcctgtaggaggtgtttaattttggtagtcttatcacgttgagctttataacaaattttaagggcggtacacgagtaagaaataaagggagaattgaatatttatgaaggcattcaattatatgtttaagtaaaataattaattaataagactctagaaaaaggaataaaaaaaaaaaagaaaccaaactaatagatacttaaaatgcatgtgtttgatttttaattatcctacgtaccaattgtaaaactcatttgtatgatatattgatataagcaacttgacaaagatattgcatcaacatgcatcaatgcatgctatagattgctagacctgttagttccacttaacatatgagtgctctctctctctctctctctctctctctctaataagttaattacttatggatttccttttttaactctttttgagatttatgatatttttcctcatcaacttacaattacttgtatccaaccgaattctgataatagtcacctgtaattaattcacgcttctcgttcattgaagaaaacttctttgatcaatgtaaattataatagaattttaatttgtaaatcataaatgattttttgttaattagaatagtttgagattttaaaagtttcaaggttttaaatatttgtatatttatgtccattatcattaaaataattatttatcaattgagttaattttatataatatttttaatttaacttttacatttttacaaatatagctgttcattgcacgatatacttaattactacttttcttttctttttattaaaaaggagaatgacaaaagagacagataaattattaaacctactagttatagtattattttctttctattatgtcttttactttccaacgtaatcatatagttttacgagaggatctaaatcccggggtaaattggtagaaagagaggatttaaatgatatatagtagtatttattaaaaaaaatcatctacaagttttttttttcccattatatactttttctttacgtgtcatcctcatctaattctttaggtatacaatcactaccacttgccatatatttttagaactctacatttttcaaaatttaggtaaacacgtactaataataaccatttttttaatctgaattataatcataagattaatattagtattagaattgaaccaaaccaaccaattggcatgcactggttgaaccagaaattaataatcaaaccagttcatttaactctagaaatcagtcttacaaaaaactggtataaaactaattgaactaatccaaaactggacgaatcatccaagtttgaatcagtttgcccaaaaaaactatttctattttatattttaaattaaaaattgatattataattgttgatataattctaaaacaataatatgatgatagataattatgtttattatctttattttttaagcgtagttactaataataaatattattatgtgttattaaatttaaatattatgatatatttgatttagtttcatatttaatttttaatattatatattatgagtcacgaattttataaatttaatttatttttttaatattatgaagttataaatattatgtgattttttgtttaatattatttaatatattatattaaaataaaaataataatattaattataattaattaaaccatttcacctcccactctgatttttaaaaccttgattcagatgtgtggctgtacacaacgttttaaaaagtggggccgtatgccgtaccaaatactactactacttaacatcaattaaatctaagtggtagattccttttcacatgtccatccaaatctaatttattaattaggatagcattgataaaacccatgcaaaatgtagaacttgtgataatcaactactaccggcaaatttaataataataataataatttacaagtagtttaaaatatgctatttaatattttgaatattatatatatatatatatatataattttctgaatatagatttggctagcttctctaaattatgcatatctcatgatttttttttcaatgttttaaaacagtcataagttattgcttatgtacataatattaactattaatcttatttattaataattaatagtattgtttatttttctctctaaaataaataagcccaaatatatacctagaggctagctagatattttacttctgattgctttctgagtacatctagcgttgggttgcacacatcattccataatatatagttttagaatatgatcaataagtatagattaatattttaaaaatggatacacagttataagagcccaaatccgcattggaaaaaattgaacaacacgtggaggttggagacagaatcgccgacttcaacattaatttcttgaaaaaagaaaactagtgaaagtggtacagtggtagtacttctttgttaatagtcattaaaaacgttagatttccaaaagatagtacattattaaaagtttttaaatattttttttagaacatcaataaaaaattaaaagtataattttttactaaaaatgatatttttttactgctattaaaaatgctgttaattaatataggagtatatccgagttatttttagcatgatatgctattattaatatttttattattatttatttaaccaatatgtttaagatattagttaataagattcaaattttaaattattaaattaaatttaagtaaatacaaatatttttttatcattagcactattattttttaaacaaaaacttttctttgcaaaatttaaaatatactccatttgtctttaaatataagataattttaattaatttatacatattaagaatttaaatttaattaatttagttagtaatattaaatttattaaaattttataattattttttaaaaattatcaagatatgcctcactttttttatttttaattatttttcatctaattaatttatatgtgctaatcattttcttcaatttttataagataatagatgaatttatcttattaatttataatatttattataaattaagaatattttaattaaaaaatattaatacaaaagaaaacttaaaaaaaatataataaaaagaaacagataaattttttaaaaaaaagtgtctaatattaggggtgttcatcaacagatccaaactgcggtaatcgaaccgaaaaatcgataactgaaataactgaaaacttaaaaaccgaaaatcgaaaaaaaaaaccgaaaattttcattggattggatcggtttttggatcggctggtgaaaaccgannnnnnnnnntctctctctctctctctctctcttcaacagccttagttcaatatattttttcatgcaaaatgattattacaaaaatattgaaaaattattcctggggcacgtctccattagccccaataaatgaatcgggtgctggagatttctctgtcaagtagtatttgatttgatttattgaaggttaaataaatgtataactcactaagcttacagaatataaactggtttacgcctgtaattaataccataataagacaaatgcaacactcaaagctaatgagtaatttcagtacaatccagctcaagcttatgattaacaagaaacaaaggccagagttaggagagtgcgttctgtgttttaaagctattttagaaaactcaggcattattgcatgaagtagtagtaaatacggagtaaatgctcctgcaaaacatcaactaacccgcatactcctccacctgctaatatttactccactctgtgaatcattttatatattcttcccagtccactcccctctccaaactcaaacccccccttctcttctttctcatagtgttctaagcagtcagtgacaatggaaaggaaaagacacagtcctatttctatcactatgttcacattgctacttggagtgctttctcagaaccttgtcatccctgtagtatctacccctgccatcattgtggaccagaagaactacaactctccagacccacatgcaggaacagatttatcaaattctctatgtaattctcttactcaactatacattttgcttcattatttatgcaaaatagaagatatcatttccttgctagctacagtaggccatttactttcaaatttgaagtacgaaggatcaatagctcttaaagaaactatcttgacatttaactttaaaatctaatagtatacgttgcttttacttcttgaaggttcatactgctctccagatcatggttctgggagtggtgggcacggaagctcaccacaccactctcatcatggaacaccctctcatcatggatctccatcacatggaggtggtggaagtcacaatccaaccccatcaactcccccaggtggtggaagctatgatccaactccatcaccaccctnnnnnnnnnntatgtttcatatggactggagattaaagtggtaaggactgaatttaatgttaatagtgaatatgacataaagatataatactacattgaatgaaaataatatctctctctcacaaacgaaaaaggacggacttaaaagtttaaattaattttaatttattgattatttattgtccaaatccacaattgcgcaatttttttttttttgccacaagaacatttttcattattgaaaaaaaaaaaactgaatatatgtacagccacaacatccttatccatttcattgtataatgactcaaggtagctagctagcgtgagtgccatatttcacgtccatattatcctgaatcaacgtgcccatagtgggctttgtgtgatataattcaagaatgattaatggggtgctgattttccatattcataagaaaattgtctatacattattatttaattactgatgaccaaagataatagatagcatatttttttcaaaaaatattaattgctaatttattgatttttttttacagggaaaattaaacttaagacatatttattttttattttttcttaaccactcaactcatctatgtgcttgctccaattctgcatcaagaatcaaccgtttgaatatataggagaaattaaggtcagacaatcatgtcgtagtcctttgtgcatatactgttcctgcctgtaggaggtgtttaattttggtagtcttatcacgttgagctttataacaaattttaagggcggtacacgagtaagaaataaagggagaattgaatatttatgaaggcattcaattatatgtttaagtaaaataattaattaataagactctagaaaaaggaataaaaaaaaaaaagaaaccaaactaatagatacttaaaatgcatgtgtttgatttttaattatcctacgtaccaattgtaaaactcatttgtatgatatattgatataagcaacttgacaaagatattgcatcaacatgcatcaatgcatgctatagattgctagacctgttagttccacttaacatatgagtgctctctctctctctctctctctctctctctaataagttaattacttatggatttccttttttaactctttttgagatttatgatatttttcctcatcaacttacaattacttgtatccaaccgaattctgataatagtcacctgtaattaattcacgcttctcgttcattgaagaaaacttctttgatcaatgtaaattataatagaattttaatttgtaaatcataaatgattttttgttaattagaatagtttgagattttaaaagtttcaaggttttaaatatttgtatatttatgtccattatcattaaaataattatttatcaattgagttaattttatataatatttttaatttaacttttacatttttacaaatatagctgttcattgcacgatatacttaattactacttttcttttctttttattaaaaaggagaatgacaaaagagacagataaattattaaacctactagttatagtattattttctttctattatgtcttttactttccaacgtaatcatatagttttacgagaggatctaaatcccggggtaaattggtagaaagagaggatttaaatgatatatagtagtatttattaaaaaaaatcatctacaagttttttttttcccattatatactttttctttacgtgtcatcctcatctaattctttaggtatacaatcactaccacttgccatatatttttagaactctacatttttcaaaatttaggtaaacacgtactaataataaccatttttttaatctgaattataatcataagattaatattagtattagaattgaaccaaaccaaccaattggcatgcactggttgaaccagaaattaataatcaaaccagttcatttaactctagaaatcagtcttacaaaaaactggtataaaactaattgaactaatccaaaactggacgaatcatccaagtttgaatcagtttgcccaaaaaaactatttctattttatattttaaattaaaaattgatattataattgttgatataattctaaaacaataatatgatgatagataattatgtttattatctttattttttaagcgtagttactaataataaatattattatgtgttattaaatttaaatattatgatatatttgatttagtttcatatttaatttttaatattatatattatgagtcacgaattttataaatttaatttatttttttaatattatgaagttataaatattatgtgattttttgtttaatattatttaatatattatattaaaataaaaataataatattaattataattaattaaaccatttcacctcccactctgatttttaaaaccttgattcagatgtgtggctgtacacaacgttttaaaaagtggggccgtatgccgtaccaaatactactactacttaacatcaattaaatctaagtggtagattccttttcacatgtccatccaaatctaatttattaattaggatagcattgataaaacccatgcaaaatgtagaacttgtgataatcaactactaccggcaaatttaataataataataataatttacaagtagtttaaaatatgctatttaatattttgaatattatatatatatatatatatataattttctgaatatagatttggctagcttctctaaattatgcatatctcatgatttttttttcaatgttttaaaacagtcataagttattgcttatgtacataatattaactattaatcttatttattaataattaatagtattgtttatttttctctctaaaataaataagcccaaatatatacctagaggctagctagatattttacttctgattgctttctgagtacatctagcgttgggttgcacacatcattccataatatatagttttagaatatgatcaataagtatagattaatattttaaaaatggatacacagttataagagcccaaatccgcattggaaaaaattgaacaacacgtggaggttggagacagaatcgccgacttcaacattaatttcttgaaaaaagaaaactagtgaaagtggtacagtggtagtacttctttgttaatagtcattaaaaacgttagatttccaaaagatagtacattattaaaagtttttaaatattttttttagaacatcaataaaaaattaaaagtataattttttactaaaaatgatatttttttactgctattaaaaatgctgttaattaatataggagtatatccgagttatttttagcatgatatgctattattaatatttttattattatttatttaaccaatatgtttaagatattagttaataagattcaaattttaaattattaaattaaatttaagtaaatacaaatatttttttatcattagcactattattttttaaacaaaaacttttctttgcaaaatttaaaatatactccatttgtctttaaatataagataattttaattaatttatacatattaagaatttaaatttaattaatttagttagtaatattaaatttattaaaattttataattattttttaaaaattatcaagatatgcctcactttttttatttttaattatttttcatctaattaatttatatgtgctaatcattttcttcaatttttataagataatagatgaatttatcttattaatttataatatttattataaattaagaatattttaattaaaaaatattaatacaaaagaaaacttaaaaaaaatataataaaaagaaacagataaattttttaaaaaaaagtgtctaatattaggggtgttcatcaacagatccaaactgcggtaatcgaaccgaaaaatcgataactgaaataactgaaaacttaaaaaccgaaaatcgaaaaaaaaaaccgaaaattttcattggattggatcggtttttggatcggctggtgaaaaccgatccaatccaaaccgatccaattataaaccttaccttaccctttacctacttgagcatatttcctatcatagaccaaaaaccaaaaaaccaatacattgctctttattttgtccaatgaaaattagaaaatagtatttgtttttgtttaatgaatttgtttgtttatgctaaatactccttattttaataaaaataagtctcataagttttatttttagactttttaaaaaatcgaaaatcgatccaatccaaaccgaaaaaaattggattgaattggattggatttaaaaaaatttcaaaccgaatagatgatcaaatgaccaaactaaaagcattagatcgaataattttttgcttcaaaaccgatccaatccaaaccgtgaacacccctatctaatatataaagaaggagacagtattaatatttgttttaatttaaaatattttcacttattataaagcaaaaaaaaaatcatatcaacagacgaataaaatgttgattatgtctatcagtttatatattctttttgaaaaaataaaatgactaaataataaaaaaatgaaattgaaaaaaatactggttatagcctcataggtaccggcagcatcacgaagaagcgggtgtaacgtcatggaggtgtcggcgaaagagtgtcaaaagagtaaataacgtgaaaaacagtggcgaaaagagagatcgcaacacaaaggtgtaattgctatattaatcatttcccgcgactttggttttcgcatttccactctctttctttatctccctcactgcagcaagccagcaactactactttctttcttttccccgtaactaaaaaactcaaccctcatttcaatcgcagaaaccgatccaaacacgaatgcaacacacactctctcttcgtccctcagatccggtgccgattcgatcggagagaaagctagctagatatagcttatagggaatggaattcagaagatgaagttctatgtatctgcaaaggggattaagagactcgtcgccggaaaaggatccgccaagaccactgctcctgcctacaccgtccccgctcgccggatttccaaccggatggtggtggtgctcggaatcgtgttgctgctcagctttgtgagagtggcggttttggtgctggaatcttccgcggtgtgctcaacctttggtaatttttcttttccgattcatttttttacttttggttcgtaattttttcttttttcttttactgttaactgttttgtagtagccagttcggtaaggaaaacagttgagtgtgggacaagtacatatgaatgaatttcagtgtatataatcatagtgaaaataataaataccgaaacttactattttcagcttcatttggcttcttctaggtccaacataataatctcaaggaaatttttatttactatctttcaaaattctcttaacgattactttaataatactggtatttttaagaaacattttgaaatgaattttttaataacaagtatttgctgcaattaaaactttttataattattttatatatataaacacatgcaataacattctttttgttttgatatttattttttcatagagaaatgcagttgtttcaatttaattagataaaacagattctatgcatagtttaaacgtgaaatttataaaacaaaggaaaggataaaagtgtagtggaatttaaaattaattaaaatattttgaaataatattatttaaatatgtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatatatgttagtgaagtaaaagtctaattttaataggagaatagtataaaatgtacttttttaatcagcggaaataataatattatcaaatgcactcataatactatgtgcacttaagatcactaatcaccaatcaatattaaatcttaatcagtaatcaaatcactagtttaagatgattgaaaatgatttttttatctcattgataagataatatgttaaatgcatatccgtataaaagagaagaaaaatacagttaaggtgtctaattaaaagagttgatagaatgaaagttttactcttcatgttactttattaaattaaatgcaatttttgatctattttcttaatttgatatattaagttttaattaaaaaattaattttaatttttatatttttgcaaactctattttgatacattaagttttaaataatttattttggtctttttataattttttttgtcatactaaagttattattttagtagtagatggtataaaaaaatcttcacactgataggacatcaaaattaaacttacatatttagcttgtttaaatcaaagttatacaaagataaatttaactcttaaatcatccttaaaatgagctcatcttttgttgaaaagttcatgacagcatctatatatgaaccattgtaattgttgcagattgcgtgggatcgacatttttcggcggaggtgacgccaatctggtagaaccaatctattattatttttgacttgtttatttttatttgaataaacaacttataagtaatcctttggataacattttttaataaattgtatgatcattaattcgttttcaggtgagctggataatgctggaataaataatttttaaatttctatgatttatttttataaaataaacgcaactataagtacactaatatatatatatatatatattatttttaataaacaagcttattagtatttatttaactgtattttttattatgtgttgtaaaaaataatgttaagataaatggcataattttttaaatttaaaatgaaaatgaatttaaatacaaacactagctgccagcacggacgatatattgttcatatggggatccgacaaaagaaaaataataagacaaaataaaagtttagaaaaataataagacataaatttttattttgtcttttttttttatcatatattcatatgggatccgacaaaaagaaaaataataagacaaaataaaagtatagaaaaaaagactatcaaatgataaatgataacaacatattaaacatataatctattatttaataaaaaaatcgtaatcaatatcttacggacacaacaaatgttaaaataatttatttaaaatttcagaaaatgggttagaaagattcagagatattttgataaaaatgatatttgactatatattctaagcttacagattaattaccatttgacatgtcagagaaccaactattttaaattacgctgaagttgaacttttatttatacatggcaatgaaccaattatttcaaattgcaagttctgaaatttagtttttatttagaataatgaggacagtaaggattgattaaattcttaaccatattatatggagactccaatattatcttataaagctgattgaaaaagctttggtaaaagcacataaatggttttatttatagctttgtaagttttaagtaaaattttaatttattctagattttatatataggaaaaagaaataagaaatatatatgaaaaatataaatgagaaaattatttattttttctctgatatttttacgtttccgtgactttcattctcgttttttacggtgatactgtatgtatgtgcatgaagaaactcagagatgagttgaccagagcgctaatagaggcaaatgatggcaatgctaatgaaggaggagcaacgtcatttaacgagcttgtgaaagtgtttgcgttaaaacaagacctcaaggcatttgctttcaagaccaaagccatggtacacacaaaatttactgattatttacgttgttaataatgtgcttttgcttgttaattactcttaggatatagtacaatgtctgaggtgtcattttaatttatgttgatatatatgtagctgtcacaaatggaacgtgaggtgcaatcagcaagaaagaaggagtcacttaattggcatatagcttcacacggtgttcctcaaagtctgcattgtctttgtttgaagttggctgaagaatacgctgtaaatgccatggcacgatctcgtctaccttctccagaacatatctctcgcctagttgatcccacctttcaccacattgttctcctaaccgacaacgtccttgcagcttctgtggttgtaacctccactattgaaaattcagccaaccctggaagactagtctttcacgttgttactgacaagaaaacttatactccaatgcatacttggtttgccatcaactctattaactcagcagttgtacaagttagagggttacaccaatatgattggtctacagaagtgaacgctggtgttagagagatgcaggaagcaaatcagttaatttggaagcactacgacaacaactataaagaaaaggcgcttgaccatagtgaagagcataacagatattttcaagctttaaagcccagcagcctttccttgttgaatcatcttcgcatctatatccctgaggtaatacatgttagttttttctttattctttagctagccctaatgctaagattgatcaaggttttaaaaaatagtagacaaccacaatttcaaagttggaaggattttgtggtgtttgcaactgcaatgagattacaaccatgactgcattagttcgcaatttcctgtgagaacaatgctgataatactctctttgttactatttttctaatattttctttataattgaccgaaatttattgacaattttgttttgagtttaacatttcatttaataactccttttcatgattcatttaataactgcttttcatgatttagaaataagactcaccaaaattgataattattccacttttcctgtaatatcaaggaactaaactaaactataggactgcaatttaaaaccttgaataagattttagtaataacaagacgaatgctcagtggtaattcatgattgtttcataatctgattttttgtggaccatcacagctgtttccagatctaaacaaggtagtattgctggatgatgatgttgtagtacaacatgacatatcttctttgtgggaactagatcttaatggaaaagtcagtggttcagtgttcaagtcatggtgtgagaacagttgctgccctggaaacaaatacgtcaactttttgaatttttcacatcctatcatatcttccaactttgatggtgataagtgtgcatggctctttggcgtgaatatatttgatcttgaagcttggaggagatcagatattactaagacctatcatcaatggttgaaacttgtaagtatattttgatgaacataaggaagttattaggcaactgcatttctatttaaaatgtgttttgacaaatttccatatgcttcaaaatggtacaagcaagataatgctttaacttcacatttttacttcttaattcgggtgtctcatcattcttaatgaacaacaacacgagtgatttgaaatgttcattaaatcttttattagtttgtatggactttgagaaatatcaagcaagtattataatgtcttagttaaatataatgcgctactagctagacacctaacgagaaatagagatataagagaaaaatgtgtagatatgtgatgcatgtgcatgtggtatatcggtgacaagactgataaaaaaaattaatatttttatcactttatatatatatctttcggtcttgattaaaacatacttcatatttattaaaaaataataattaattaatttcattaaattatgttatttttaattaaaaaataaatatttttctaaattattttttattgaaacttgatattaaacatgaaaaatatgaatacattttagagataatcttattaaataagatatatataattaaaatttgtttatatttgaaataaaaaaataaagaatttgtattgcttgtatttaagatcctaggaagtatatacattatgtaggtgtgcatctatcattagtcatcttataattgagatagagaaataataattgcccactatattcaattctttatcatggagggtgctgttttcttctgtcttgtgaattctgatgatcatactaattaactgcatgtatacttgtatgatttgaaatttgacatagaacgtccagtctgggttgacattatggaatcctggagtgcttccacctgccttgattgcttttgcgggtcaagtgcaccccatagattcatcatggttcgtcactgatttgggttatcgccatcgatcagaagaaattagcaatagcatagagagtgtggaagctgctgctgttgttcatttcaacggcccagcaaagccgtggcttgaaattggcttacctgaggttcgaattttatggactagatatgtaaatttctccgataagtttattagcaaatgtaggattatagtgtgaagagacaaagctattccacctccaatatggagatagaatcaatgataccgtatgggataagaggaaagaaggtcttgccttcagtctctgacttacggtaatgctccctgcatgtccatatatacatatatagcaaatagatgaatcaagtatacaatacgtaccctgttagaagaagctagcagtagctctacagtttaagagtatgaagatataagcatcataatccagtagtctagtaaattattttgtttttcataatggagatattgttttacttgaacagcatttgtatcttgttaattttggattttagatccttacttgcattgaatgttacagttaaattaagggttaacaaatctccgtacatattattaacccttttcggtatgattatttttaattttctagattgattctaggtatatagatgcaaaatcaattgatatagaaagcaggggtttttaagaaggattgattctaatagtaaccgattttataaaagagtattttacattagtatacttaggttcggtccccaacaatatacaagtgtggctacagtaaaatttgagagaattttgttcactttatacgagagagctataatgttggagcctttatatatatatatatatatgcgtgactttttttctttataaaaattaaaagtatattttgttttatcaatcaaaatttaagttttatttattttattctcaaatcaaccctaattatatttctctttaaatttaattatacctattgaataatttatatgaacgagaattaatccgtcctttactttaagtgcatctatataaatggatccaattattttcatgaacactagtactgtatattttttatatttaattgaaatttaaataaaaataatagcaatataaattccaacgtatttaattagaggaactataaaataaaaacaaaaattaatgtgcccatagaagacactgatcaatatttaatttattttatatttgtaatatgtatctagtaataatgttttaatggtgaccgtcttaaacaataaaattgcttttggaattagtaatttttttagctttctaggtaataaaagttaattttagatgtatataccacataattttagacatatatttacaattttatcttatacatgatttttttaagactaaattttctaaattaacttttgaaaatttatttctacataaaaataattcttttaacatcaattatataaagtaattgtactaaaagttaaatgcgggaggagattttgagtcaaaaggccctaacaatttgatatgtgaatctttataattatgtttttgaaataagacttcctagaaaaaaacacttcaacaccaaacttttaaaataatatttacccattcacttttttggttatgatgggtaacaaagtaacaaaataataactcaattaaaataagagatgaaaaaagagtatatgagatcataatgagtgaaaagaattttactaattaagtgaaagaaagtacaacatttctctctctgaacacaaaaaaagcacattgacactctaccaaagaggaaaatactactaaaagaacggagaaactatttttttcatttttttttctctaagtagactaaataaataaaggaagaagagaaatgattttgggatgtgaacaaagggtccaccaagccttcttttatggctctggagtgcaagctaaaagcaaagctcaccatgtgggactttgtccctaacagtttatttatattatactaccatttatcttataacatttattgtttttctatctctctttcttgtataaattttttgtcaaaatttgatatatgataacattaatcttatataacctcaaggatacaaacctttcaaaaaggaggcaaaggaacctgcacaattgattggtacaatttcactgtgactccaacctggacaacaaggaacagaccccgttaacaaatgttgccgagtttggtcactatatatactgcaagaaattaaccgaggatttttgaagcaaaactgcttaaagatttaggacaacagggattactacttaatacaatttctgtatgtatgctggaggcagggaatggacaggtctactatgtgatttttttctctcacgtgaatgggtatattcttaagttatgttgaaatcatgcagccgaagagcttatacctaaaacacgtacctatttggataatttttctggtaattataagagaaaaaataataagtaaaaatgaaataaacattatacacaaattaaaattaacttatatataatgttttgacaaaggttacatataagttaaaattaattttttaaagaagttaaaacaaaaagaacttactaattttcacctagggtgaattgaagttcatttaagtttactttcttattttcatttctataagtgtttataaggaaatctatccgaacaatttattatggattgcgggcctaataatagaatgtggttaggctcgttaatgttttaagtttaggtatcatgttctcctaaaagtctaaacttaataaactcaaacatttctaacttattcactttgattttttatttttattttactcaacgtaagacttgcaacacaatcaaatacaatagttgtgttattcctcatatgcttgagaatcagaagttacccactgacctagcttaatcctcctctttgttgtatgtccaactttgaagttttaagcctgacttcttcaaaacaaggattttttccccaactagcggagagtgatcatggcatatgaaaaaaatgcaattattcaggctttttgtatattcagaattatataattggggggaatataatggagaaattatatatgatgaataatgcggacgcccaattaacttttactcctcgataggtatagtgttaatattgaaataagcatttataacataaaaatacaatatgccaggactgaatagaaactatatatattgaaagatacataaacaatatcatatgatgtattggtacaagtgctgattagcttttgtcttgttctccgttgtaagaactttagcaaaggaatttctatgggcactctcattcacgaaacataggacgatgtaagggctcccacaccacttgaaaggctgtggcataatttcaaatcacttatcagctgcatccaaaggtgagaatttaaggaagtgagaaacatatcaaaaaggttagttaatgtttgccatggggaatcatctgtcaaaatcatgaacttatggatttgtatataaaaaacacagcataaaaaggttaatacatctctttctaccaagtcatattatttattatttatacttgtctctaactttttctctttatattgcttaaaaaaaactttttctctttatatttaactatagatattaccatattggtgtccactcatcttttttctattaaaaaatttcatatacaaaaaaggaagagggatttcaaaaaaagacttgagtaggagctatgatctttgaatctcgatcaaatgtgaaatttaccccggttgactattgaaaacaagttatagcttggctatgccatttggattggggagatgctgaataacaaatcctacattgatgacttaaaaacaagtaaaatgatatatatgtaagtcgaactatttcttatgttccaatgcacgttgaaccacaattttactgagagaaagctttggcgttcaaactgctaaagggcaatacaaacacagcctgagtcatttaagttgaacgtccactaaccactttcccacactaaaacccatgttgttattagccatttaaaaaccttatataatgcatatatggttgcatgtatataaaggattggtacaatgttgaaagcaattaagttgtttgtttcattggtcattgcccctcgagcttgttttagttttcatcaattaataattattaaaagggcattcaataacaacaacttgtaattaacagtgaaagcagggacggaaccaggggggggctagggtgggccaccgccccccctaccaaaattaataaaaaaaatgaaaatgaaaggaaaaaaaaaaagaggaaagaaaaaatattaaaaaaagagaaaacgagaaagaaaaaaatataaaaaatatagtaaaaaaaaaagaaaaagaatatgaaaacaataaaaaggaaagaaaatataaaagagaaaaaaatatatataaaaaaggaaagaaaatataataaaaataaaatgagaaagagagataacagaaaaagaaaaaaaggaaagaaagatgataaaacagaaaaaataaaaataaaaaggaaaagaataaagagaaagagggagaaagaacactataaaagggagaggtctggacacaggaaaaaaaagaaacacaaatcccaagagaacagaaagagtcaaaaaaattatttatttggtaaaccagtgaaagaaaagagtttcaggtatcccttcattctttcctttttccctctttttctctttcttcttcttgttgttcttggtttgatttgtttccatattgattatagtattctccaagcaaagatgctgcattttgtttgccttgttatttatttagtaaaccatgtggcagtggtcgttttggacttaatacatttgttgttgagggatttagaaattggaaaaaggttaatgaaggagaaaaatgtgcttttctacactcaaagcataaaaatgttgtgaattcatgtagtaatcttatgaaccaatctcaacatattgagatattggttgaaaaacttacttatcaagagattgtaactaatcgtttgagactacaagtttctatggatgtgacaagatggcttgctcttcaaggatatgcttttagaggtcatgataaaagcttagattcacttaatcgttgtaatttccttaagatggtaaagtttttagcttcctataaccaagaagttgtaacagttgttttagaaaaaactcttcaaaatgcatcatataattcccctaaaattcaaaaggaaattcttcatattttatctgaaaaggttaagaacacaatacgagaagaaattttcaataccaagttttgtcttattattaatgaagctagtgatgtatctagaaaatagcatatgactattgttttgtgattcgtagataaaaatagataaaaatgcatcatatggttttatctgaagtgattttaatttatgtaataatttttttaatattagatttgtattgtttttggagtatttttatttttatttatgatataattttttttatattcgtcccctctcaataaaattcctggttccgccactgagtgaaagatgagtgtacttacacaagttgaagagcagtctggtcttgacgtgaatattgattattggaatctatgagattaacaggaaagaaattgcggtcatatgattgtgaaggtatggttgactcgcacacgtttcccggtatcatatcctgttgcctttgttgtgctctctcgtgttcagctatctacatgcatgcatcatccaccaactatatattattaattatcattcatctcaacatacactttatatatagagtcttggagggaattaagagatgatcaccttagctctcagaaaattattatggttttgcagctctatttcctgcattttttcagcaagtataatgttcatgttagaagaaatataaatatcaggcataaatttgcaagattttataattcccttcgtacgaagcaatcaagccatttttactttatttttcacgattattggaatttcttctgggtttatcccgtttcagtttcatattcttggtcctattaattgaaaatatgcatttggtttcaatatcgtaaaactttgatatattttctttagatactatatatatgcatatatatatatatatatatatatatatatatatatatatatatatatatatatannnnnnnnnnnnnnnnnnnnnnnnnnnnnnnnnnttatatatatatatatatatatatatatatatatatatatatatatatataactgaaggagaaactaactaatttaactgttatcttgttgagttaatagataactgattgctaactgtttcaacctgtatataatctatgaaattgtaaaaaataggttaaatttcgacaaatcatcctaaactcatgaaaataggttgagttgcattatgcaattatatgttaaatttacataacttgctaactcaatgggtcaaaaggtggattcttttgtcaattattttgttggaattttattggacataattttattaatttttttgctaatgatattagcatgatattaatttttcaagaactgtgaatatatatgcatattataccaataagtgttgattttattgaactattatttattttgttattttgttgctttactttatattttttcatgatgataaattttaaacaacatttatactaagactatttagtaagatagtattattatgataatgacaatatatttagatttttttaaagtatttatttgttttatttattggataagtctgagttaaatattatatatatatatatatataatatttatatatttaaaaacaattatggctaattcaatccaacccataatgcactaagattgggctggatcgattgtgattttcatcccattcttaaaatttgtccaatccatttttaattttatgagttgagagcagattaaattggattgaattggtttgatccattttaacattgtctagtgtgtgactcatcatacccctcaataccaaactgtcaaatattggtgaagatgtcccttgaacatttgaactcgtaaatgtcacattcaaaactaagcattagactattagagtatcctaatgataaaggattttagtggctttgagaagattgtagcttgaaataattaaccttcacgctgtaattctattaagaaaaatatgccataattttaaaacaacatttattctggaccaaattaaccaaacaagagcattttctatcatttctttgattttttttttagcttactaaattacctgtgtattagcttcagagacagattctgcatttgtggaagcagcacatgctttcttgtacctatcgatagttcctctaacactgcaaaacaatacaacaaatagaaacataaaaatgtgataaagtacatgctaattttaccaaaacatgtacacagtgacgacttaatctgtagtttacaaattaattatgaactcatcttctttgacattaaattcttaggccaaaaagctttgagtttgtaataaaaatgggtgtatctttataatttagcgtaaatatgtttttaatttctataaaattagtaattttgatttttgtccttataattttatttttaattttcatcctgcaaaaagttaaattgtgtgacattcgttaacagcttatgtgttcagcggaatgtcaagtcagggtcgttcctgaaaattctttggcccaggcgaagtgaaaaaaatggacccctaacacacaaattttttgaaatacaaataatattaaaactaagagatggaaaaaatgaacccttaatacacaaattttttgaaatacaaataatattaaaactaaaggatgaaaaaatggatctctaacacacaaaaaatgggccctaatacataaattttttgaaatacaaataatattaaaactaagggatggaaaaaatgggccctgacacacaaattttttgaaatacaaataatattaaaattaagagatggaaaaaatggacctctaacacataaaataatctctaacatacgttttatttttattttatttttttaaaaaaataaattttacttaaactactcgtacaaaaaattttggaccatggacaggcgtcctgttggccctgccccagggccggccctgtgtcaagtgaccctcccaagtaacaacagctagtgtctatatatatatggtacaatgtcaacatgtaatatcttaaaaaggatttctagagattaaaaaagatatgttttatagggaccaaaattaagatttattcatattttaaggggaaaaatcaataattttaaattttaaagggatggaaagcaaagaaaaaaaattataagaaccaaataacatgctaattttataggaactaaaatatatttaagctttataatttttaatttcaatgtccattggaatctatgaaattgacaaattacattacatctattacatgtaagagaaatgctaggaacaaattatctaacacattctttgttattgattgaaaattattataaattataaaattctgtgcatcttcttatctagtgaatcttacccataatgataattaatattaaaagaatatatatgttattaatatttctctttcatataaatagctcagtgacctcttgctttaatttatttgtttaccttacagtgttaggccctctccaaatttttctattaagaacacaaaaattaacaagctagttgattgagtatggttaaatacacgaagtttcattcttttgataaagaatggtaaatcccatctgtctgaacttctctaaagttcaaatacaaagtggttatttactgagtatgcaggaagaggtcgatgttgcatcagtgggccggtgtaagtttaactttctctttaattgaaatgtccaaaacacatatataatagagagaatagggaaagaattgacgtcaggaatgggaagctttattccacaaagatgaaagcaataaaaacatatgggaaagagaactaatttgcctttagccattcttagaatctgctatcatcatgttacttttagctacttagggtaaagaaatcagaagcgcagaagcgggaataataatatctaaacactatgatatattttcttaagaaatataggagatgaggatgagaaaatgaggttgtagtttctcataaaaattgtttctctacacttctaaaaatatttatttctcctaaaagttgtttctctacacttcataattttatagttttatgcacaaaatcaaattcttacacgtttgccttttcatcttaattcatttgttttttgttttttgttttttgttttacgtacccaaaagaaattcaagttatttaaagtaaaatcaccaaataataccctatgggctgggaaatgccctaaccatattagactttcctccattatgtaaaggacaaaatttacgaaaatgggaaacaaattgggacatccataaccctcgatatacttattagtttaaaatgatttactttatgctcaaaaagagtttataacgaatactttagtaagaattttaaaaaatattgaaggattatagactaaaaatgcccttaattaattataaacaattaatcctgtgaaaattctgttgcaactttaaagaaaattgtacccattttgaatcaagagccctaatatctgatttgattgcttcttcgtgtaacctcattgtacggagataaaaatattcttaaaaagagaaactatattagtacaaattatatttttgtatgtaataaaaatattatacaataaaaagatatatatatatatatatatataaagatgttataaaaaaaatatacaagtttactatgtgaataaaagtctgaaagggttatttagtttgcagtttctgcgcatttccccctgatctatctcattagaattgaagtggtcttcctccaactttgtgtacatatgtaaaaacgaattgacgtgattgtggtgtgactaaatactaaatagtgaaaagtctgaaaccctaactcccaattggatgagatgcttgtgttgtgtcactatacattgacaaataagtggtattaaggaggagtcaagatggaaggggctcattgagtgcatgacagctttgtgcagcagcccagacccttttaagatttgatggatgacaagtggagagagaaactcaagagagagggattggtaaagcttaacaatagcagatacaccaggaagctaagatttctcacctgcaaatctttgtaaccctaactaaagctttctcttcatttgctacatacttcatattgtttcaccttaacgtctataatttctatcgcttacacagatctgcacccttcttaacaaatcactgggaagacgcgtgatagagcaacaattaagtacaagagttagaaagaatgatatatatatacatggtgaacctagagtattcatcggtcagaatttaaaaaaactaatttttcaaagtattaatgcttgtttaaataattagcctcttttattagacattttttcatacatataaattaaaaaattaaacttttaacgacatatgattatctactaactatgcgtttcagttatatatgataccacataacaaacaaaaataatcataataagaaaaaaggtcttaaccccatatataaaacccttgttgtttctagatatggtttgtgttatttaaatgattcataagatatgaaatgagattgaaggagaggaaaagtactgtgttggatcagtagtaaaagaatatttgaacctgttgttggcatactcatagaggcgtccacggcttgagaagacaacaagagcaacctcagcatcgcacagaacagacaattcataagccttcttgagcaacccgttacggcgtttgcagaaggtaacttgcctattcgttgtgttctcgatccgcttgatttctattttccctcttcccgttttcttctgtgaacacccttctgatattgcttcgttgggaaactccatctatggctgcaaccagagctatctagttaaaaaatttaattagcaaaaaaaaaaaaaagtaaaacaccgaaagttggtatttaatttggagtatcacttcattaaggatgcaagaaattaattaggagaactaaagaagaagctttggaataaaaaggtcattaaactataagctattaagcttgtccttgatatgaagataataatcaatcaaagacagaatggaaagaaacacggggtgtgtatctagctagctaattaggttgtacctatgcaatgagaactatttgtagttctttggtgttatgcaacatgtgaggagaaaatgttgcaaaatatggaagtggggtggcctatgagacaggtatttatggacagaaaatagaccctccaactctcagtactgaaaataataatttggtagtaactccttgtgtaatgtttggaaaataaaagaaaaagggtatagtgagaaggggtttgggatttcacctgtcaactttcatgctcaatgtattaaccgttcatttttcttcatgtatgggaaaaaggtgagggggggacaatgaaagtgtctttttgaaagtgactttgttaatgagtggggtttcattcaattccaatgagagggacgtgaacgtaagtttgcacgcaaaaacttggaaagcttgaatttttgaagcatagctgcagggttgcttcttggattttgagttttggcattttatcctgctagaatctaatctagatttgtttccctccacttcagccccgtttctctttctctcatgcttgaaacctgagttttcaattgctcactcaacccaactcttgcattttttgaatttaagacaaattaagtttggattcatgttaaatgatttagagtcaccttgaaatatcaggtaacaaaattttaaataatattcatatgtttgttttatgttaaaaaatcaattttgcatctggaattgattgaattgagaaaactttaagtgtgtggcatggtgtcagattagatcctctataatgttgaaatatcatttttagttaaataaatttttatgttttcacattaaagaattttgagttttagaattgataaaaaaaacatccaaacataaaacatataacttcaaaatcaattttaatgatacttagatatacactaagtaatttttgtattgaatgaaaaaatttataaagttttactactaatgtccatttagaataaaaaacatacaaatataaattatatcattttaaaattaattttactaaatctcatctaaacacacgtataatatttgaataagcatgtaaaattgattttaaattaaattaattttaattaattttttttaagtaaactcatttatgtttgaatgtttaacaataagttaatagtaaagttttatataatttttcatcatagacaaaatttatctaaaattactttaatttaaaattaattttagactaaaaaataatttatcaaatatatgtgaatattgcgcactatatttacatcttaagtatttgaactaggtttattaatattatatttcataggtctttttgttgattttatacatatttctttccatttagatagcaacgtaatattgtgtatttttgttaatacaatgtttcttaatttacgatattatatgaattaagtcatgattaaaaaaaaaaagacaaatacttagtgtaatatcattaaattccatttccatggagtgttagtatgattcattatttttttattgcagaatttgaccaggttttatgttgacgtatttgcataggcttcaatatataccttgtattttgggtaatgggaaaatcagacttgtattctcagttgcaatttttctttcttctcgtgactttccagtatcttgttgatttaaatgacttggttaatatttaaattatcttcattaaaccttttgaatttggtgttacaatgtgttaggacacagcggtgtgacctcacatgacccttgtggagttatggtgggtacatatatagactcatcatcaggaacaaaatatatatctatgaagttaaaccattgtatttgtttttgttgtttgagtgtctacttgcatgatacgagactaatctttcaattaaagattcttatttattagtgcatgcacttctcaagtcccttcagtcggatttcttcattaggctcagttggagctccctttgttccatgccctcatgtatcgaccaaggaattcttgattaccagttcagcattctactttttgcaatgcttagttgttaagcaactttaatcactcgcccgaggatctcggaacaacagatagaatcacacactatactcttgcaaaaatatcggattgattagttctgatgcaattctataagcttaacctaaaaaaacaattacacctaatacttgaatgttcttgaattagatctccttctaagcatgatctagttaaaggaacaattaaaaattacaatttttttactataatataaacacatgttaggttgatgtaattaactaactattatattatattgaaggaaaaaaaactaactattgtgtttaaaattaattaagaaaatttaaataatataagcttttatggagaaaaaaaaagatactactaaaaaataaacgttgaagttaattacagaaaatgctaatttcataacacggttatcttcaacggtggcccgtttaagcccttgttttcaaatatatgaatgcagtttataaggtgtgcatgtgtaatagttaatcgaatttatttaaaataataataattttttttttcttcagattacataattagaatcaaacttatgactgattaatcgtacatatgatgatttcatcaaaaaatcgtacctatgatacataaagagactaatctaagtagggatggcaaacgggccgacccgcaaaaaaaaaggggcatgctggtccgacccacaaaaaatgcggggcgggctggcccggtccgcttttgcaaagtgggctacaaatgctagtccgccccgctttaatgcgggccagcgggctagcgggctagcccgcatcaaaaatttaaaaaaataaaaaagtcaatttaaaaaataaaatacaaaaaaattataaaaaaatacaaatatgataattaaaaaaaaacaaagttaaataaaagtaaataatttaaaattaatgctaaataaatgatgtcatgtgataattcacaaaattataccatttgcaaatgaaatttacggttataaactgtccaaaagtgtaatatgctagtaatgaaagactatttgaaagtatcattatcataactattttaatattaaaacttaaaagttaattatgagagtgtaaaagagtataaattaaaaaaatatacctatttcaaaatatgttaaatatatttatttaattttaatatttaatatttaaataatataggcccagcggactggtccgtcccgctccgcgtttggcccgcaattttgcaggacgggctagtccagcccgcttttgatttgtgggttgatattatcaacccagtccgcatttttttgcggactaagcggaccggcccggcagaccaagcccgatttgccatccctaaacctaagttctgaaccaattaattagtcaaacattcaagtaatagatcatagatgttgggcctaaatcccgagcataacctttacgtcaatgagctacaaattttcacactagaattgaagcatattgaaatcttttcctgtgtttaaactccttttttgtttcttcttttaaccgtgtgtttctgcatttaatcaaaatttacgtgtgtcgaccgaaagttagaaattataacttctgcgtaacagactcaagttgacgtgatatttctcttgatacgtagtatatataaacatgagtgagagttttatatatcatttatgatagaaccgatgtttcacactacatctgaaataaaaaccttagtcgtttattagatctatatctaatatatatcttcatatgcacttaagtaattcgtttttcacttgtgaaatcttcactcacttaaaatagtcgtgcatttgacatatttgatgaaatttatagagctgtcaatttgagatagtccgatctatttgtattggtcaatcaaggagcatgcaaaaaaaaaatggtttagctagggcaggtcaaattaatattgagctaaaattttgtaagttcaatccattccttgaggagaagtagtctaaatgaattgatcactaaaagcttatttgagagcttatttgaataagtttttttagaagtagaaaaaaaaaaagaaaaaaaaaataatgagataaactttttcattagctaaaataagattttcattagtcactatataagatttttaatatatttttctaaaagataaaagaatatttataaattaattaatggttaactaataaaaaatttattttaactagagaaattgatttcatttttttcttcttattttcttatcttataagtgttactaaaagaacttatccaaacacaaacaagttctaactcttctagaatataattaaaaaaataaaattatcaaagtaaactaacttttacaaacaaattaataacatatttttttaatcactataaactaaaataaaaatatataagttgttaattgttctataagacagcataattcaatacacaataatagaaataaaatagtgtgcgtgaattaaaagtaatcattatgtgttattaggttatggagatattttagaagaagaaaaaaatgttttatgaagatttttaatactcaatatcttaaaattattaacaatgttaaatctacattgacaaaagggttagaatgaataaatttaaaatataaaagattaaaatgaatattttaaaagatgaagaaagtcaaattgaataaaaaagataaattaagaaccaaaagtgatatttaatctattaataatgttgattgtttggttgtgtcttttatacacagttgatcttaatatacttaagaggttggagtattggaatgcatgcatattttctttttttatgcacacaagaataaattaagagatgccttagcatctcatactgataaagaataacattgtgtaatctatttaaagccctcaacaatgcagcaaatttataatagtatggttcatcaaccatgtcgatgagatagataacgtgaacacatattctagttagaagaaatatactgggtaagacgataattatgctctataataatttgtgttttactctcagataagacagtggtttagatgatatatatgttcgggtaattgtataagttattattaagtttaaatttttgtacataaaaaagaatttaaatatgaataaattattaaaaggaccaaacctggtgagaatgtttcattacaaagtaaaaataatttaattacggcggtttaaaaaaatggatatactgttcatccttgctcccaaaactctattaggtatagaaattattacatcttcattaatttctaagtgataggggcaggcagatattataagttattagcatacttcaacgagaatatatatgacttcgcaaataaaattgcgcatttaatcattcattatatattatatatcttttcatgtgcatatatacaattaatatttttttattaacaataataaacttaatcacttgatataacatttagtcgtacttaaaattcattattccttctttcgaatatattatgtagctacacttaaaattcattatagggattaaatttatatccttctccacaatttagcttatgttgtgaattgagctgcactcaatgcatatatatacaattaatatattctcaccatttttgaattggacagtttgaaaattaaaagcacagataaaagaagtagaagaagaaaaaaaaaactcttcattagtttaaactactttgattagtcttacttaaatgtctttcacaaagaaaaaagaaaacgattttgcaagatcacaccatctaattcattcactgatgaatatattaggaccctctttgcaaacaatttctgtttcagatatcaaatatcatggaaaaataaaagggccgatggaaattaatgtaacttcaatcacataactaaataagcacatcgttgagatatgaatgataaaagttatctaccagtactacttccatttggtagtatgctatagaagtaactcaaagaaagagtaggcaatataatttgctcaaagaaaataagcatagtaattaattatctacaacttctcttctgtctgcctgctgccattgattcgtgattataagatgatctaaaatgtatcatcaaatttgtctcatgtaaaatccactgaagatgcggaccagacaaaggaaatctttctcaattcctaatgccctatgtattttatcaaatgcaatgagtttcttcttctttttttctcataaaaaaattagattaattgaggaaaaacgcatctccttaattgccaaagactatattaatttcagcgagaatttatagtaaaagttacacatccttttttttatcagccaaaggaaaaatttattattatactaaaagggtaccagtggtaccttccaaacagaaccatgcaaccataaagaaaactgtcttaagacctgttaaaccacaattccttttatttcgcaaaaaaaaaaaaaaaatgacctgttaaactacaaccatacacatcgcttactaataaaaatctgatgatcgaactcaaatcacaatagtgtgaacgaaacactcgagtagaagttttggtaatgcaataatgagtttcttttaggtacaatgtaaactaatattgtatttcgggaacgcctatagcttgccagtaactagtgccatctaataatttcataggcatattcatcgatttagttagctgcagtgtgaatggtccctagccattatttagatttcattctctagcaacatatatttaattatataccattgttttgttgaaccttacaaattcaaattttccccatgcatatgccatctgttctgaacaatttaatgccaatattaaggctacattctatgtcctagcctcctacgtacgtgacctaacatcataaaaggaaatttgaatccttgaagcttcttctttaaggaccacgttgttctaacatggaaagggttttgataataacccattgataagtgcaattattccttcataccaactcataatcatggtgtctgaaatttgggcatacaatcatctttttcttgacaacttctgatcgatcacatgagagctaattaaagttagttgttatgcatttatatgaccattcaacacttacaactacgacaattaacaggtatttccaagagaaaaataatttccaatacttgctaatataaatcagaaggtctatgaaagcatatacacttggtgattaaattagttagaaggtaagaccatcacgtatcacgtagtagttttaaacgtgaaaaattaccccaagtattttatcatgttagctacgagcaagtaataatgtttgataaagtaaattaacatttgatggacctgtttggatgttagcttttctagaagcacttctagaagagaaaagtatgaagaaaaaaatgaaataagctttttcataaattaaaataagtatttcattaactaatttgtagatgtcatctcatcttttagagaagttacattggtgagcttctacaaattagttaatggaaaatttatttttacttatggagaaactcatcttatctttttgctcttattttcttcttctaaaagtgcttctagagaagcttacccaaacatacccgatatcccttacgactgaataagtgataagctaggaaaagaagaaagataaataattagtgataagatgtgacaaaaatgagagacgcttgaatatagtgggtgtctaaacataaacaacaatagtatttacgcctttctctctgttctctaattttctttttaggtgtcaattatgactcaagtctccatggatatttttccgaccaagtattatcttttatggattgatgacgacatgaaaaccaattctttatactcgcattagaaaaagaaaaaagatcaggaacaaggattttttgaggtgggacagagtgaagaatgtaggacaagaacaaggattgaaacacatacacgtcatttctacacttcaactatgattgctgagaatctttcatgtgctgaaaatcgtttacttgcgttgaacactgattcctagagatgctagttatttccttgcaaagcctcacattatttcagtaaccatccatacattgtattggatgtataccaaaatcttgcttcaatgtgaatgggaatgtacttgactcaaatgcctttgacaattttctggccaaaaaactagttacttcttgtacgttgaataatacattcaacaaactgctcaccaaataagaagttaatggacagagccgcagaggaataatttgatcatcatcggtaaattttatcacacaatttttttaaagtcagcgcttacggagtagattcaatcttattgatgattgtggatttttaaatttaagacaattgaggattgaacatgctagacatgctgccacaatacaattatacaagttttgccagaaacgaggttgttgcttttatttgactattgagtacaccaaaaaacttgaacttcttttacaaatttcatcatgcatatataattgcagcaggacaatgataattgagcaggctacttctaagtggattacaaatacgttagtaccgactaaaaggagtaaaattgtatcactcctatcgaatcacaccaaaatgaaatagatcaagatgttgtgtagatatgagattatacagttgatgatgaattaattaaatttaattgatattgtctataccaacaagatatatctatttttcagtagtctgtcacttaagaatttcacagttaaacgtgtttgacttgaaatagttatgggaggaatgaccttctaataagttttccgaaaagcgtatgaataaggacaaagtatgctgaaaagtgttgtgttgatatgcagcgacagtcattgatactcaaagcaatcaaagtatattgtcgaggttccgaaaagaactatacacgaaaggttataatcaatggagtgttatagtgttctaagccgtcaagaaatccacaattaaaaatattataataacaaatacaagtaaaacatgtaagtagtggactacttactattcaaatataagaacagtaaaatcctatgatgatgataatagaagtaatagaactgagagaaccatatcactgaaggttctaagagagaatatataatagggaaaaactttggaactatctatgaaagttagtaaaatggaaacagggcacaacaataaaattgtatcccgaacagaagaggcacatatgcgtctgataagcccaatggagaaaacaaagttgacaaagaaaaataggataatatgttaagaatggctagtaaaagtaagtcagaaaaaaaatgctttacccgaatttgttgtcttccaattgccctacattgtctactccggtaattcatagtcatgccaatgaatacataatgtatggaccacaccagaacagcaatattgtgatcatagttaacagctgtgatttgtgaagcacaagtcaaaattcctaaaactctagtagccaattgatgattgattaggtgagggaccacgactaaaaaatacaacgtaaggagttgaagcaggacaattaattcattgttgaaaatctcattacaaagaaatcaacactctggcatgggtggaatgattttgtaggaaacaaaaaaatgtgtaccgtgtacgtgcgagacgaaacaacttgttaacgtcatttaaatattatccttttgcatttgctttgaattgattagccatggaattagttgggggtatacttgcaacattgcaaccctcattcttcgttctttttgttggttgggatcataaaaggaaaggaaaataaataactttttctatccaatccctcattttttctttgtgtagcttatcgtcattggtcacgaccaaagatattttcgtgatctttaaaaaaaaaatcaattaatcaaccttaataggatatgtttgactgtcaacacggaaagatccataataatctacaaatcaaactacatataaagaacaaatttgtattgacaaacagtggacatgacttttgctctatttctaatgttctatggatacacacaagaaaaatgatttattaaaaatataccagtataatttactattaaatttatatgtttatcaaataatttcaagaaacggaaataaacttcttttatcttcataatacttgtttgatatttaaatatttaaacaatactccatctggtccttatcactataaaacattttggacatcaattatacaaaccaataaaattaattaattcaattgattctattgaatttatatataaaaaaatactactaatgtgtcaattatgtccttattaacaatcattaacttgttatggatgatgtgaaaacattaaaatgctagagtattatacatcactatcaataaaaaacataaatacttaaaagacaaatattaaaacatatgtctttggaatattggttaagaaactaaaataaaataaaatgatatcctatgttttacataataaatacttactcattttaatttattaatcaatgttacgagaacactaattaacaagactcataattagaatatttgataagatcaaccaatgaaagaaaaattaaatattttataaaaattctaaaatctcttataaaaagtatcattcattttttcttaaagtatctcttatgataaaggagtagagtgagtaaaattgatgtgaattaaatgtgttggctaaagggcttattttccattgtttataagagtatgggctaggtttaagtggcccaataatattatgctctgaaaccaaaaaatggaggcccaataatgagcaggttttccaccgcgcctccgtgactccttcctccttttgagtttcattacattgttcgttgggcccaccaaaagcactcaaaatttcaaccatgctgcaacccttacttcaagatgcagtcttcgtaagtccttacttttttattctgcttcaattcatcccctgtgtttgctccttgtttttcataaaagccttcagtttatagctattgagctctcttttttttctgatgaaaaaattgcgctttataatagtcaatctgaagttgtgaagtttcacatattaagctttgtgtaaatcggtaggccaaagtatgcattgcattcattatgtcatggatagatcccctaacatttttattgtcatgatatatatggtgggagggaatccacttatatatagagagagtggggaaggaaaaaggagatatcaagttattataaaaaataattttaaaagaattattttttattctaatcatttattttcttaaaatctaataattattataactctaaaagatttactctatattccatgttgatgaggtgatttttgcatggtgaagtagtaattaacttgctttggtttcatgcatgtgctgaaaaccaaactagtggaccgttctttgcttggtggattaaggaataacaacttatctgtcttattaacatcgcatgagatagcatccagcaatttcttatctcaggtcagtttatgaattatggcaatatcatagttgtgaaaattgtgatcatgagtgatatttttaaggacaatacttgtcaagttttttaggtgttttacttttttatgctgtctcagtttcacttccgtaatctactcgtagtaagttttgctttaaaggattacacggattatcaagataaaactccaattctaatgggagaacagtgcatcgcgaacaatatctaaggaactatatatgtaagttttgtcctattttcagtgacatgttatttatttttcttacctttgctacacttagtcatttgaagttgtagacaaccttgtaatgcaaaggtgccagacatggattagtgactgactgactaatgaaaaaaattgttttgctttagcagcaacagcaacgcaagttcatacagatgggaacggttctgaaggtggttgataactcatgagcgatgtgcattcaagaattgaaagggaagaagggggcaaggttaggtgacaccataataacatcaatgaaggaggcacaaccgaatggaaaagtgaagaaagaaaaggtagtgtatggtgtggttgtgcatgcggccatggatgcaaaaggggaaggtgtgatgaaagtgaggtcaagtttgatgacaatgctgtggtgcttgtggacaagcatggccaacccattgggactagagtttttgggcagaagaagcatgtcaagattcttactttggctggccatattgcttgaatcagcttagattttcttaattttggaatcaccccttcactttttctgattgaatcttttggaatttgtgtgtgtaaaatgtactaactgtaacttgaattgatcgggctctattaggcaaaagagaaaaacgggagtgtacaattcatgtcatcactttagggaaagagaaaaacagatgtattggaatttttacccttgaaataacaagtagcaagcaaatgggatacaatattcttgtttgcttcttgtgtggaggagttattatgttcatgattgcatttgagaaactttttttcatagatgtataggtgtgttattttccttttactgatattaaatcgtcttgcctgattctatacgaagttaattttgtaaaattagagtcaatccgatgatcaaatgatcagtgcctaatccttgtttttttaatggaaccgtgagtggataaaaattactaataacgtattaacgttattcaaacatgaaatttcaatactcttttaactttttttctccctttttttcttatctatatagaaaatgttttacatagatacaagttgttgggatcattcatgacaaaagtccaatacccttgctctattaaacaatttttaatatgaatttgataaattcaactattaaaaattcgtttatatagaatattatagtatttatttatattttaaaaaaatattatagtttaaatgaattttttgattaagtattagttaatttttaaattctgcaatttattttataaacttgacgtgtttaataagatcaatttatagtaataaaattagcattcaaaaagaggtattgaatgcaataagctggaaaccataccaaaaaaataaaataaaaaatcatgataccgtgaaagaatttaattctgaccattattaaaatggattatcaagattaaatttaagtcaaataatcctaatcacctactatatatttatggtcaacatgttacctctcatttctcactttcccattagatagttgtatatattttttaatagaagataattttcgtataatgataataatgaaatttgaatttgtcaccttctacaaattattcaaactccttttcactaacaagatcctagtgactcaaagcactttcttgatatcgttcaatcttattaattttaacattttatttgtttgcttgaaatcttattttaacatttgacgtactatattaataaaccgaagagatatcaaattgtattaaataatgtgacaggacaacattaagtacaagtacaaaacttttttatactgacattacactaaagaggaaattaaaatcatgtatacatagacacatatttcagaaaattaagaagaagagagaaaaagtagattctctcgggaccctaatactattaatgtagggtttcaattaaattgaatttgatgggtactattttgtcctatatactaaaggcttaaggccgtagtagtagtactttttacgcaactctaccgagactgggaaaaacaattgaaagggtaggcaccttggtaacatttaatgccacaatgacaaaagcttagagctcaaaaggtaatacgataactctcgaatatgcaccaaaggcacatgaaatcccaaagttttggcatccttatattcccctcccgttttgttacacatatagtataccttaatctttatggtctctttcctctcttgagagaaaaagaagacttttggttcattccacaaacattcctttcctttccttcattcacctgctactacactaaatatatacatctttgcatgcatcaacaatacaacccatattccttcaaatcttcttaaaagttgaatttccccaccagcaaatatctgaatatcgcagtttctacatcatgggtgtccttggaacaatggcaagacatttggacacaataatagggtgaataaattaatctctctccattaatttgctttcaaaaatatctgcaatttgtgtcgtatatatattttatttcattccactccacatgcattgctatattatatctgcgccttaacagaatatatacttttcacacaatacctgctaaatcccatgtacaaaactcatttaataaaaaaatattcaccataatatgtattctgcaatttaacacacaactgtaactataggtttttcattttatgttttttcccgtaacaattaacagcctttttttttttgttttctgcatgccaggcctggagtgatgcttctttatcctctgtaagtatagtaaatgccatatcatattatcatgcaatcgtgtatcattttctcttcctccggattaactgctgtaattcttaattaacaatcaataaaaagaaattaattaagcatcctacgcagaggcatgcatgcacattatcttatctgtattaattattacatgatatgactaatcatcaaattcttgactacttctgagtaaatatcatagatacgcatcaatgagagcaattgaaagtccttcaaccttggatgatcaacagtggctaacgtattgggttttatactccttcatgaccctctttgagctttccactcataagatccttgcttggtacgttgacatcaatttcatgtcaaatcaaactatatatatatatatatatataggcacataatagtaatttaatatttgaactttggcataaaaatatatacaggtttcccatttggggatacctgaagcttatgttttgcgtctggttggtacttccaatgttcaatggagcggcttacatatatgagaattacgtgaggcaatacataaagaatattggaagttccaattattctgaggagtacaagaaggtccttcacatgatgaccttcgatgcaaggaaagcagttgaaagctataacgatagatatggccctgatgcctttgatagagtagtcagagcggtatgatacaaaacaactatgaattgcttcatcgtaaagctcatttatatatctgtgtttttaacaattttttgttaactttcatatgtgcaggctgaaaaagaagcaaagaagcgatgagtgaggaacgtcaacattgtgaaatcgatacttctttctttgtatattttaacatgaaggagacggaggaatctattgtttaattaaactaaatggcagcgattatatgcttcatatattttatgtgtatcttccatggtttaagaatgtacgtaagggtattcgatctagtttgatatagtcattttctgatttagttaagaaacaaaaattatttggttaaattacctcagtttttcgctaaatcctttaaaccctttaacgagaattctactgcaacggttactaattggtttcctctaagttccttcagcataactattaactacacatacccacaaactcatgcttaattgggataaaaataatggaaaagcttagcttgacgatctcaaaaaccataatgctttcataagcaacctttattgggtaatactcatcttcaaacaaagcaacgtacgtaatagtcattatgtataaattaaagtggcggaaacccaatcttataataaaataaaaccagttccatcagcctttttccttcaacactttggcatacactatatagtaacttttttatgcatatacactatattgtaacttttttatgcatatacactatatagtaactgatactgtgttgaatgaatgtttttaacagataataattaaaatcaggaagaaaataaaaattgaaacataaaatcatgcactcgtatgatgaattatcctacactcttccgattttttatgtggaaacattctaaaacgtaacaacttcaccccctccttattttcacttttcatacaaagatgctgttggttattattttctattacttattagcatcacttccacctcagcaatacataattaagtttaaaatacaaaaaagtttggccgataatacttggagaagtatgatctacaagacagagaatcaaacaggaggatcgactgcaatactttgcctattggattttgataaaattttgtgtttatttcgtgttgcattaataaaataataagcgttagtgtaccggcaattaaagaatatctgacacataattagctcattttgactcaaatgaatatgaaatccgtttaaatttaataaattcatcaatgtaacatctcctttgtaattgaaattggaatgaattagtcaaattgatttatttaatatattaaaataattacaaaaacgtaattcagtttaaattctctcacaacttaagacatgaatgcaaattgaaactatttttccatcaaaagcaacttcactggattaaccttttatattcaaagcagcttgtaatcatttttttttttagaagtttttaaatgaaaaataataattttttcataaagaatcaaagccgggatggtagaatttttttttttcttcataatttgccagttcaaattaatgaggaagtatccaatggttaatgaataactaaagccccaaattcaagttttattgaataggttaagagagatggactattcccttatcctaaagcccatctttctttcctttctggtgtatcagtaataagcacatctttgcatagtcattgaacagatgccatgtggggaatacctggctcaaaaatagatatccaaagcgtcattattcattggagacaaaattctgtaaagggcataaacttcaaaactgagagctggatgtatcgaaagactggatggaattatatcaatttttccaccggtttcagcaacctggcaatattgatacatggataatcctgttatgttctcaaatggatatatactatggaggaggaaaaacagatatgataaaatgatataacttacacctaaaatcagtatactttagtaaattttctctgaatttctatatcactaacactgtcagtaatcgcaggtgagaatatggcagaatagcttgtcatcctgatccatattttaagaggaatttaagatgtgctttgctcttttaggaccaagtcggacaggacctgatgttaccatgccgtccagtttaaaagaatttacagcagaataacttccaggatttagattttgtgcctcatgctgacaacacctactcctagcactgcccatgtgcggatccagttcgagtgctcttgtgtttcgttgcaattccacacttgacttttctccaggcaacctagtcatacgactgaagttttcttgcactcgtatattcggtaacttggtaggttttctggaatcatcaagattggctgcagctgcaggtctctttctggtatttgtgcacagctgatggtcatcaaacttcaatctgtcagcgaccttatttatgtttatattaccactatttatggtagagggtgtaaccggaacatgtagtggatgaccaattgatactggagaaagaggagtcgtctgcatgggacctagagaagaagtcagatgattagaaggaaagcgaacttctgctgaatgattcacaaatggcgtagtgaaattatttccccacagattttgaggaaaattttgactacttgaagcagaaaattgccgagaaaagatccctggtagcatttcatctgttgagattgacaaccacgatggtgaacttctgtagggactatcaaaccaagatgttttggcctgttcattcacagttggctgcaagaaaggaaatcctccaaaggctgattttgtaacatggggatttttgttcctgtcattcagctcaccattggctacatgagtcgagtgactaaaattgccaggtgtaggtagtaccactaattgagaactcaatcctagaggtttagctccaggtataaactgctctgaaaagtcattggatgcaccattaaatactgcataagtagacttttgagtaatgggattgaaataagaactggcatttaagttgactccatgattactttgccgaccaataaactgttgagagaatccagagtctgtactgctcatcaatatggtgccttgtgctgcttgattgctttgaatttttgcggcttgcaatacattgtcagctgatatttgtataggtgaaccagatacccaatcctgcttagaacttctttccaataaagagtgatctaaagcagcatattcagaataattccttctggattcctcatcaggccaaacatctcctgcaaattgttgcatctcttggctgcttctaccaattggaacatctttacccatcaacctcattgttggttggctggaacttggtgatatatgatgtgaaccttctttcagagaaatcaccccatttccattgtgattccagacccggtcacattgattctgttcaatgaacgagttttccttacagttcaactctgaattaagtggcggaacatagtgactggaacacatatctgaagaattaggtcggttgatatcttctctctctctagattgtaactcagtgacaggtaatcgggctggatgatgtggaaatggattaagactatcttttggaaatgtcttctgaacaacatgattctcattaatgcttaaattttcctggttactttgatggagaatattattaatgggtaagccactaaaagaaccacgtaacgtacttgatgtatctgactggttcatccctaagtttccacttgaactgaaattgattaggtcaccgtgagaattgagtggcaaaccaaaaaaatccggatccaaacagctatttttgccacttcctttctcccagcctgtattggggaatgagttatcaatcatatctgcagaaaacatacgagaaaattgcctacccaaggcctcgccactgttatctttatctccacaagtttgcaatggagattctggtttttcatttgcattatatgaagcagaataagatgaagaaggctccagaaatgtctttgtattttcatttgagttaacagcatcaacctgtggatcatccaagtggttgaacttcccactgtagctgaaagatccagattcacacatctgtgtatttataccagacatctgctcttcttggactgctaaaagaggtctagaaatgtcagcatacggagaacaatgcagggtatttctgttccctcggtaaaaaaactgtgaatcattattgtcacaaactgccaccttagtcaacaattctgacttctcttctaactgttttgacttctcttgattgatacatggcttcaagaagctttgtacggtatcttggtccagagtgttagaaaactgtttactttcaactatagggcaaacctcctctctcttgcctctgtcaatatggtcataatttctgtttggctccaaacttgcagtttcttcatcacttccagaggacttttcctttactactgaagatgccaccacatctgaagatatcttgaacatggtttcatcaaatgaatttgtcttttttggaccaagtagatctttgccagagaatttcacatgtctgtccgaggttgcctcttgatcattataatagctttcttgagcaccatctccaatactactgccacttgacgtcttttcagaaacatgtttgaagcggttcttaagaatgccatgaaaaggagatacagctttttcttgctttccaactgagtcgcagtttttaacttgttgcttcttttctaccgataagcaatttatacctgatttctttctatcgatagaaggatcaacctcatgcagtggaagcattttattaccgattgtacctttcagttttctggaactgtttactgcactttgcaccatgcgctcgtaaacatcatcctgagatagacaagattaataaaattatgaatgttatattataataaaataagaataagctgactaaccattaggatatgcaaaatatgaagataaatataataacacctcttgtagcctgtagcttttatatctttctcctttcttttcttttttatggatgtcatgttgtagtttttataagaaaataaacaaaattacaacaacagtttcatgtataatgatgccaaaatgtatgtttatgaaacagacactgtagaaaatcagcatttcatatcctttcaacaattccaatcagaaatagtgaaaggatttcaattgtctatgactgttgctacattacaatttacaataacttgatgtccaaagatgaatgtccctaaaactttactcagaccattggtttttcagtttttttataattcttgtccctcatcaaaaagctttttgtaaaagattgaggcaacttcgttcgtgcctatatcttgtgtctacataagataaaacggcaaagacgttttcaaatggaatttatggtcaagtaaaagtagatttaatacaaaagaacaatttcacgatggaaagtttcagggaactatacaaactatatttccagcgttaattataaaatcacgatccaaacttctggataaacaaactctttgattattaagtgaattttttttaattttctataattaggaaaagactttagtgacatttgaataacactttaattggggttttaagtaccccatcattcatttaaaaacaaatcaaattgaaatacattaagatcaactacatgtagaagtttataaaattgaaacaattgaattaagaacgaaattatatcattattttatcatgataagaaatttcagaaacgcttaaaacaaaattcttaaacttggtcattttagtatcaattttcagaaaagggaaacatagaaatttatatatgtatatatcataaatgcatagatcatatatttaagtagccataaaataaacttaggtactaagaaaaacaattgaaatttttgtaaccaatacatcccagaaacgctcgtagttaataaatataaggttatttgagcttatatattctggtacaaatacactactatttttaaatctttacgagtgaataactgaatatacatgaaataaccatatatcaagctagatgaatgtataattatatatatgaatatcagcatgaagaatgcatgagagcttcaattcaaaatcttatttattgataatttttacgtgttgatagaaagaacaaatccctaatattgattttacttaacaaacagaacgctaaacaagcttgtagaatttggcacgaatatttttttttttaaaatttcgttgtaactgaaagctggggcgtaaaataattatatgctattaagatattaaaaatccggtaagttgcaattacactttatgataaaataaacaaaattgtaaagacaaccctttttgtaacaaaatttctaccttctacaattccactatgcgaatcttctgtttgaaatcacaagagattacttctaaaatatcatatccaaagtgtaattctataacaacatatatattcttatcattgtttatacgaagaagaagctaacgaaaacacatgcatggatatagcaaatagtattaggacaaacaactattacagattctgaaattaaacgatatcaccatgaggttaaaattattattgtaaaatatttatacgataaatatcttacttagttcgttcttttagaaaggcaatttaaaatgcaaattaattaaattaaattttaaaaattagtgggatattggattctattaaaaggggaggggatggacaatggcaaatgcatgaatcatgatgcttaaataatttttttacataaatttgagactgctatgtaattgttcactgttgaaactagaaatgcacatatcacatgatacacctctgtagaaatttacgtggtccagataaccccattcgaaacctgagatttctttagaatctgaatgccgaaaaaatccaatatattttaatcttgtaaaagaaatggtaggtaggaaaaatatagaatcggagttcgagaattatttttggaaaataaagtatttactaagactagtctagaaacgttatttaaaacaatctagacactataaaaagatgccattactgatacagtaaggacagtcaagttataaatttcacttcttaggatagagttggctgcaagatcatatcatccttatatcatcatcgagtaaccttcatggctagccaagttaaatatttgactactttacttccactttcaaatttcggccagcgtaaccacaaactgacgttggtttcggttttctattgcttctatatacacctcctaggttgggttcaaatagacactcacatcgattagatcgtatctcaaaattgtctgcacatgtccaaaacatgagtcgctaacttatgttgaccgatacatccaagtcattctacccaaaaacgaacactttcacaatataaaatcaggtgtctcacacaacgacagaaagtccaaaaccattatacgtaccatacatcaccaccccctacttcactaatacgccataaaatatgcccatgcgataatgatctatatcaacccaagccagagtattcttttttgacgatacatgcccatctggaaattgcatatgcgaacattcatcaatccaaatcactaaatatacacttctgacagacccaataaatgatctatcaaattctggacctccacttgcagatctcccacaagccaaaatacatccagctgtaagctgcgtataaaacctctctacgtccgaaaaactggccacaagagatatatgagaatctgttgatctacccatagcacatacgataatccccccccaaattattagttaatagtgacggggctagagaaacccctcatcattagactcagctctctcttctacctcgtaacccatgagtggccccttctagctagggtacttgtactgattatacacacaacacacactacagctggagcaacattcttgcaggcttcactaccttctgaatcccttccgcgcacgaaggcactggtcatagttttccttttttcgtaactctcctttcccaacttttacttgtcgcgtatttcgctcaagtactcaacaaaaaaaaaaaaaaaaaaacacccactnnnnnnnnnnnnnnnnnnnnnnnnnnnnnnntaatcagctttttcagcagtaattttatgcagaaaaagcaagacatagagtaaggaaagctataatcccatggcataagaaactacatcaatccaaaatctacattctacagtgtcgggtaatattttatgcgcaaattccatgaatttgtatacttatcagccaggaattagctgcaaatcgcggaaacacacagcaaataacggaagattaacttatattttatgagacgcagaccacataccttgttcccagttggtccgttgttgaagacattcttttttttcttcttcttcttgctcgcaaccgtctgcttctcattgctcacgaaccacacactactatcgccgtgcttctccaccttgcttttcttcttcttcaccttcttcaactttttcttgttcctattcttcatcgtactcttcttgttcttaattaccgaagcaacgggagtagcaacagcagcagaaggagcaggagtggcggcactagttgaatctccacctgaatagccataatcggatttctcctcatcttcttcctcaacctgaatcgctttccttttgccggcttcgatcggtggcgccaccgtaagaatctccgcgatcgagcgcttcttcggcgccttcggtatgggcttgcaattaaccgtcgaccttctcatctgccgccgttcctccctgacggcctgcgcgaggcaaccgtctatgtgtgcgtttactgccgtcaccgtggcggcgttgaaatctcgacaaacaggacacaccatctccatcttctcctccgaggaatctccttggtccgatttcgccgactcgccgcctccgcgcgtggatctcagcgcctccagccgccgagaaagccactcgaacttcgtgacggtaatcgaaacatcgtccgcctcgccctcgcggaacggccagaacttcaacaccctctcgatttgcggcggcggctgaggctgcggctgtggctgtggcggatgtggctgctcctccaccttgaaaatctcggctatggaacgcttcttcggcggcttcgactttgacgacgaagatttcaaattcataatcctcatgtggcgacgctcctctctcatcgtctgcgcgaggcatccgtcgatgtgcgcgttcaccgccgtgagcgtcgcggcgttgaattcgcggcacaccggacaaaccatctccagtttctcgtcttcgttgttgttattgttgttcgccgccgaggagtcggaaggaggcgcggatttctcggattccatagattctgcagattcatcttcgctgcaatctctgtcgccgtcgtcgtcatcagttctagaaacttccgcagcagaaggcggaatctccggattttgagggcggcggtcgttggaatcgccggatctagggcacaggttcatcggcggaagccacgactgaacctcgtcacgtgatacgtcacgtgaggaggtggatgcgaacggccagcacttgaaaacgtcgatggacctcatcttggatgtgtagtccctgcaacagcaacaccgaatcaaaacctataaagcgcgcttctatatattagtaaaaccaaatccacaaacaatagataatagaaaaaatagatataccttatggagaatccatcaaacgtagccgccatgataagtgattacaagaagggagagactatgaagaagaagaagaagaagaagattgagaaaagaggaacatcgatgattatgattagatgagagagagagtaatcaacgttttgcgctctcacaccagaagagaagaaggaggaggaataggagagagtgttgtgtgtagctgtctgcttgcttttccctaatttatgactgaaagggacgtatgagagagagagagagagagacgacagatacagaagaaacgaaggtgagagaatattttattaattattaattaaactcgcattaattatttaattaacactcatgttttattataatgttaatgttggtgcttgttactgtaattgattttcgctgattaattattttattattgctaatcaactcttgcgctttattcttttctttccatgcatattattttcatcttaaaaaaaaaaaaaatgaagttattgcgaattgtgtgtgttgccttgctggtggctgctccgccgaaggttaagcgatgtatgtattaaaatgatagtatagttaaagggggcgtataatgtatactgtatggtattatttgttaaatgctaatgttagatttgtagtatgatctatgctgttatatgcccacgctcgtctacttgtatgaaacaaagattctgctgtaagaccacaaataatccaccatacgcgatcacccaccaatccacgcgctttctaccattataatatcacttctttttttaaaaaatatattattataaatagtttccaaattacttacattgttttcttttttttatacaattaacgctttatttttcatggttttgagttccacttaaataataagaaataaatatatataattaagaactaaaggataaatcaagtgacattatacattaaataataagtactaccttaggagaaactcaaatttcaattactacttaatctttatggttcttccttttttttaaaatatgtgtacagataggagaaaataacaaaagaaaaattgttttccttcttttcttctaatactttcatttttttagttctattaatttagatttacttttgcttcatatttcatggggaagagattataaagaaataatgagaaagagatgtgacaacagatagagtagcaaaattaaatataattttctttctttcttttaatattttcatttcttgagttttatgaaattatattcactttcactttgtacttgctgacgaataaatgacaaagaaacggtaagaaagaggtgtgatataggagagaacaataagagtcaatattctttaatactttcatttctagagttttactattaatttagagtcacttttttctcagtgtttggcaagaaaatggcaaaagaaacaacgagaaagaggcctaaaaatgaaatataacaacaaaagtcaatttaatatttatgaaatatgctgaaaagaaattaaaataaagtggcgggcctcaatcgcatttctttccgagtaaaaaagatgaaaaatgacaaagaaacacataataattttacctagaattaattttgcatgacgacataatcttttttgtataataatttgctgccgatcgacatctacttacatcttgcattgaccatgaacttataatttgtgtgtctcttattttaatccaattcttatcaacttacaatacatatgtctcttgttttaattcaattttcataattctctgaaaaacacaaatcccaacctctctaaaacaaaacacactcaccaccctcattaattattcaactatttgaaactattttatcacgagaaatagagtgaattttctttctttctttttggtgctataaaacaaccttcttagagctgaaaaatagggaataaaaaaatataaaaattatgtatctgaaaaataggaagaaaaacaagtaacaaattattctcattcaaatgttgaaagtttctattcttcctcgtttaatttgttcgcatccaaacaaaaggtgaaacattagtaaaaaaaaatgaacgaaaatataaggtatcaagaaagatattaaaacaagtactcttgactgtatttgaattcttggttgaaatgccttaacttgaatatataatgagtcaaatatttttttttatttaccatgatatttgacattgtattaaaaatatgattataaattttagactcaagtctcattaaaaatattaaagaaatatttttacattaatactaattcaagtcacgatatttgtctaaagtatattcttaattatgtcatctgttctaaatatacctttaattagacttaatttttttgataattacatactcaaaatcaatcttaattagtagtacaagttttcaaacaaaacattgtgtattaaagtccctttttaaatatcttttatccaaaaaaaatcatatcattgtaaattactttgaatcaattttagaaaattacattgattcaaaataaattataggaatacatattcaaatatacacttgagtgtggagagggtctagcttggttaaacaataacatgaattgttgtaaattttttgacaatgtctttaatgtttacagataaaaaaacatacacttgagcaatgaacatttttatctttttttcgaagaaatgaacatatttatcttttcatgcgtaaaattaaatcccttagtcatcaaatttttatgggttttcgtatttgttgtttaatagtatatcagtgttattcgtatgaaaatgttttgtcctttgagacacttcaaaatatttaaacattgtatttacttttcctaaatatttgatgatcacttactaaatttgaaactaaataattgcctacaagttcactgagagatgcttcgatatgagtccaactccatccattgattcattcatcaatcaaattagaccatggcatacaattaagttatgatggtgagggaggcaacaaggaagcaattagaagaaaggaataaatattttgattggggcagagggaattcgaaatcgcaattaatgcctggtttgtggttttttgttagtttttattattattaatttttaagttaatatgtttgttatttattagttgcaacttttatatttttttaaaataattagaatacaccaaaaatattttacattattatttaattacaattatcatatatgattacaattttaaatttaatataaaaaatagagtaaattttagagacttacatcactgcgatctactttgacttaaaacgttgaaagtccaagataatcaagaatacctacaataaagtccactacaagagacccaattataagataagtttgatacattttagaataggggagcatgcattagcctatgggtgagtacccatagttattaataaaaataaaatttgttgggtttgattttttttttttaccaactatatatgcaacaaatttaattttaaataatgaaattaatataaaaattttgcgcttctttaaatgtgcattttacatactatctctaaaaagttatctcaaacaactattgtcctatttatatactttactttcctagttgtttatcaatttcaacaaatcctattataatattattttaaattaaaatgaaattgttttttaaaagaacttatcaatagttaaaataatttataaggattgacaacttcaattttgagattaaaaaaacatttttttatcctcctcttatcatcttgaatcttctgagcattatttatgagattttaacttcttcttttttgctttaaattcacaaatctacatacattactatgtaaattttgaaaaataaactggatcaaggccaaaaattactttcaaaacaattactattgtcacatcacaattattctcttattttccaataattacataattaaataattaaacaaaaattatgtttataaaagcgatataaaacattgcaagagttagagtagtttataaaagtataatttaatcttttctcgtataaatttgttctctccatctaattttattcattgaaaataaaggacaaggcatgagaaagaatgaacaaactcatacatgaaaaaaaatatgatgctgttgtttataaattttctcatgcacttcaaatataaataaaaactaaagtaaaaataatgtaaaatttacaaaatgagaagaaaaaagagagagaaaacctacttatatattataaaaataaacgtttgtcttgtgcatcgcggaagttaaaatattagttatagtcatcaagtagttgaaaacttatagtgatcatttccattcatcggaagtgaatgtctacggattttataaatttcaacattcaagtttcaaccttattgtattatgaaaagtgatatttataggaaacaaaaattcaaatttttaataattaatccttaataaaaaaatgttatcactgtttttgacaactatcgatagtcaccactcaccattaactatctcaataactttgattctttttatttttaaatatttgtttctagttaaattcgtttttaaaaatatacactgcaatacttaatagaaataattttaatattaaaatatgcacggaaaaatctaagtcaactaggattagtctttaaagcatagcttaatccatgattagatactttagatgtactcgatcgagaccttaaaaagaaatggtctaagacaggacgcatgcaggttggtcgcagttggataagatgtattcaatctggacatttgtacataaaatatacctggatagaatgcatctaaattggacaaatttagatatatagattaagataaatgataattaaagctagcttgaaagaagaaattgtacattataattatccaaagatgtatataatcctctaaaaatgtaagttagtttacaaatttagttttcatcagttttcatttttattaattgaccataatactttttacaatgtttcttcaaaatcactgaacaaggtgtgtgtgtgtgtgtgtgtgtgtgtgtgtgtgtgtgtgtgtgtgtgtgtgtgtgtnnnnnnnnnnnnnnnnnnnnnnnnnnnnnnnnnnnnnnnnnnnnnnnnnnnnnnnnnnnnnnnagataatcaactagctgtgatgagtaagagattaattgattcgtcaaaatattttttgtctttttcttatttattatttttcttaaatatgaatttataattttttaatacgaactttttattttatttttaatctatattctcatttttatttatactttcttaaatattcggtatacgagattaagataagacctattatgattcactgaatgcgattataacttctaaaaacgcttgtatataagaaaatcttctaaaaacattatgatagaaaaaataatttcttaaaatattctcattcaacatgagcctttgatttacaatacagaactagacttaaactgaaaacaaggaattatttgattcttttataattttttaaataagttttaattttaaattaagaattaatctcatagttgttgtcataaaaaatcaaaaacttatatagatatttgagattccattagagaaccaaattttttaattacaatgactaaaaaacagttcaaggttagaaaataagaaataaaataaaaaagttttttttttaattttaaaaataattaataaaaattaccaccgtatcataaaaaattttataaatgatcaattttgtctttgtattttatattcgccatgtaaatatatcgacaatttagtcttatagtgaagtttcatctgttttcgttaatgttgagtgtcaacgtgacacatccttgatgacgtgacaaatccacgtttgcaggagatgttccacatcagtcacaatgttttggactaaaatgttagtgatttatttattttaaaatttataaaggtaatgactattttaagtacatgagactcttctttctaatttcatgataatattttcttctggatcgacaaaatggtcccccaaaaatataacttaataataaaatggttcgtgacaatattgtgaatttaaagacgtgcatgtatcatagtaaaaaaacatacataagatcagtctccagagtcccaataacattcttcaccatccatgtacatactccaacaccctttcattatttcgaacaagtcgacctttgtggtgcaacataaggttaatctttttagacattcgataaaaggaaacacacaaaatagagtcaaaagaagaagaaaatagagcacctttgtatcaataataaaatttattccctttcatacccaaaacagagcatcattgtttcagttcatcaaagcatcatcaacaaaccctaaaccctaacacatgtgttaatcccttgtttgtctacaataatgaaaaaataggaagaaatctaataaaaatgacagccacatggagaaatgttacaaaaacggaggttatcaataaagtccagccaaacaaaaaaaaaacatcttaccttatgaagttgcctttcatcttcaatgcacaagaagaaatcaaacgaaaatggcaaccaccaaccaaacaccaccatttgtcgccaagttgtcataggcatctatgatgcaaaggcaataaagagcatatcaaacttagcacccacaattcaacccctttcttacaaaatgtaaaaaggaagaggataaatggtgaattaataaaaggcaaaaacatacacatactccaattgacaatttggtccatacatacttggtccaacacatggctttcacttccaccacgtggatttgtcacgtcgtctttcatgtgccacattgccaaaaatgttaacaaaaatgaaggacacttgacagtaggactaaattgtcgatacatttaaataattgtagactaaattgatcattttcatagtacaaaaactaaattgacaattagtgtaaagtacaaagaccaaattggtcacttaccctaaaaaaaagtagttatacatgaattactcataattttgaacactctatcaacgcctctaatttctcttcatctttatctttttatgacatcataaatcttatcatacatatatttgtttcctctccctagatattgggtagcatattattattaggtgtctagaaaacattttccttaaaaaaaattatttttgaaaagctataaaaactatttttacttatcaaaaatagttatgaaacaagaaagtccacatctatgggtaaatgaccaatttggtccctctgaaagatgcatccgatgataatttgatccttgaaatatgaaataaccaatttagtccataaatgtgcaaatgttgtaacaagttggtccgaccatcaagtctttattgtttccattaacctttgtgcacacatgacacgaatgtaactaacgtggcacctccacaaggtcaagggacgagacacgtcttatgcacaccgttttggacgaaaatgtcacctagcaaggttggcaatgacctcgtcgctagcctcgagtatctctgacgacaattaaaaggcaacgttggagaagacatcgatgctagcttggtgcttgggggaatcgacctcgacagagggctaggtttcgacgtcgaggatcttgttctcaatgtcgatggcagagtggatcatcttggtgtgctcgttgtgcatggttgcaagcatagtgacaaggtaagtgttgctaacgctatggaggatgattgtgagggccatgaagatcttagtgtacttgcggccaaacttctctagcgtgacatcaacgctgcgacaggtcataatgacaatgcagccaacctggttgcacttaaagacattgacagagttgtgttggtctgtgacagtgatgtcgatgacgtaagtgtagttcacaagatggactactttgtcactaaatgtttgacttatggaggtgtattttgaggaaccaaacattaattatcaatttggtccaaaataagatgctttgaaaagttaaatattaggtgacaatttagtccaaaataatatgtatctgacgtgtcttaacacttgatcttatgaaggtgccatgcgtacacgaggattaacaaaaacataaaagacctaatgactgaatcaaattatcataatatttatacatttataaattaaattagttatttctatctttttatctcttattactattttttttctaacgttgtagatactattcttgagaactgaaaagacgtggaatggaagtatcatgaagcgcgtgaaagggacgagttgtgtggtgtcgtgtgtggcgatgcttagaatatgaggcgcccccactaacacacacacacacagtcacacagtttcttgcagcgcgcatcattttgactttaagaccttttgtttgtttgaactttaaagtaacgtacaccgcaaattaccaacttctccaacacagggtctttatctttagcatgtttagaccaaaccataggatgcagccaaacactctcagatttaatttaggtagatagagtttttttttttccaagttaaatatgttagataaaattatagttgggtgatagtaaatataactttaaatatcaattataatgtgatctaaaagtaaactattattagtatataaaagttataatttataaaccatattgaatccaaaatatttcatgatttgtgaacactcaatcatgcataaattttaagaattaatagtataaagaacttctgtattagtattcaacggcaataaattaacatatatgataaattgttaattttaataagtatcttaaaaagttatatttataataattttctaattgattgatgatgtaattttttataatattataagtattatttgtaggaagtaattttattcgagttaaataaaatataataattatttttgaatatttaatttaattacaattgcctaactaaaatttaaatttaattttttaattaaattaaaataattctgtccattaattcacatgttaaataatattaaatttaatatttagattttatttgagagttttataattatgtattgataaagttaaatattattaatcatttaactttatcacatatcactgttattataaattttaatataattatgataaaaagtaggaaatattattttacatgacaatttataaattcttatttgaatataattactgtgaagaatatagttggggcgtggcaatctggcataatgatacacgaagtgactgaaaacatcatggatgcatgcggtcaaagaaaacgacaagaaggtaggacccacccactaatgataatggtattcgtgtcgtgtagtgcacagattattctctttctctctaattctaatctaatctcactttggtagtttggtttcgtttgcatcatgcctagcttccaattccaacacccaaatgcaattttcagttcttacctctctgtttccctctacactcccgaatcctcctcactcatctggtatgtgactataatcattataatatataatttcatcaaattagtctttattctagtttggaaatacttccatgcattttctattttatatatttctatttctttagcatatataacttactgatatcatgattcatgatatatattttttgttactcattttattatgatacctgccccaatccttaatcaagggatcatttcagtaaagaaaatgaaatataatttaaattcggctggagtatggacttggtgataaaaatatatatggacttgctgttttagctcagcactttttctggaagagcttaaatttatatatattctttttcaatttttgtttgaggagtagaaattagcacagtggtttgctgattttcattcccaaaatgagcaaagcaggtgtcaggtgtttgggttgttgaaatttgttgttatttttgaaatttcaaccatattttggatattttttcagttgatttttttttcctttctcttccaatgatgctttttttttcctgtaacagattgaggatcagattcaagtgcatctttttgttgaaatcatttcctgtttgctgatcctggctgatgaagaagttggaggagattgatattcaacctttgaaggttgttgaaacagaatctacagtccaagcaggcaagcaccctccaagagaattgaaggtccccaagtcactgttaattgaaacctccaaaaccaagtccgaggatcaaacaactgcaacacaatatacagcaagaaggtaacaagaaattccaactagacctccatcatgagtatggaatattttactgaaattgttttatgcattcaaatgggggatattagaggagtgttagcaatacactctctattccctatacgatggttaatttatggttaattaatgaaaactacaaaattatgattgaggcagatgagcaaagttttgtgagttttgaattaattttaatccataataaagagtatattcaaaagagtctgttactgacagacatttctcaatggggaaatataaatataagtcacaaatgaaatgcatgagattaagtttgcttcagacaggaacaagaaattgaaaaatgattggcatttatttattgaggcaatgctagattttttctgaagctcttcggggatcataattcataagtaaaccatgttgtcattccaaccagaaagaaaagaatcaaaagatgaaggagatggttgctgtttgctttgataattgaatgaacaattaatgcaagagaggcattgagtaggatagcaatcatggaagagctaccctttaggtttgtgtgaaagcagaaggatttagatacaacttgagtgttgttcagcttttatttaatgttccatccaggatgtacaatgacaaccagcgagggaacagttttaaaatttacataaataaaaacataagaaagggcttattatctcttatgtaaattaccttgcaaaatgtaagccttactactgattgttggactgaacgtggatgcaaaatctgaatttaattatatgtgcatcatttccccctttatagataaagaagtacacagtccacaagaggattatgatgaatttgttacctactgagtattgacaaaaggagggggtgactcttaagttaatttgactatagaaatatagtgagattaaaaatttgactaattgtacaaagatgaaaagcaaatcacttgtgtctggggtgttcaaataaggtggaattccaccttgatgttagagtttgcttttaaattacaaataacattttagagacttgaagatactaatgagaactatttgtttgagttttaggtgtaaaaggatcttccagagatctagttattgatgattgatgacattaaatccatggatatagcaaaatgaaacgaaagcatgagaactattaattggggaaacttaattagttacttaatgctatttgtttataccaagtttttgtgggaccaaagatatataaaataaactttgttgagtttctttaatttgctaccggtatggttttgaactgcaaaagcattgacttccaattaatgtgaaagaaacattaaccttgttgtttgagcattatttcttttattgtaaggtagtagctcaagaactgaatgcttatgagttttagttttgttaactccttggcaagtgtaccaattcgtctaagtagtagtaaaacggtaagaccgagtgtcagaatccacatagattttaactgtactcagagtttgtatatatctaattttaagttaataaatgactaaactatatacttgtcaagcgataatgcagaaatgcaaaattcaaccataaataaagataacaaggtagagcacacacaagagacagaaaaacaaacacttggaggtgtaaattgtcgtttggtgcagatttttgtggacgtgtttggtgttcgacctaccgaaactactcatgatgcaatgttagagatttttcaccatttaacgttattccgactattacctttatcctctaaattaccctaaccatgtttcctcatgtaaaatagtctaaattacttaattttactcctaatcccttaagaactacatcaaataatttgttttaagaataaagatgtataattaaggctaaataacaccattttatccataaacatggattccctaggagttccttcaagttcttagggtgcaaacaattcccaatgattaaaaccctataacatacatgtgaatgggtgatcaaatcataaacaagacaataaactcacaaaagaagcaataatattaaaatagcataaaatggttagtaatgatcatcacatcaagagtgtttggttgcctagcccctaacaatgggtgatttagcctctcatagtcatgagagactcaaatacaaaatgaagcaaaggaaatagaagaagaaggactcaagtaagtgggttttcattccctattgtgccttactatttgtcccttaatagtacagtgctcctcctttgtattcttcaaaatgctgcacattcgtgtttttcgaaaatgaatgtgcgctaaacctgcatgtgctcgctgagcgcacatgcaaagtccaactgacttaagtgaccaagcgctaagcctccaattgcgcacttaggactcatgcacgatattggcttctcgcgctgagcgtgcactggcatgatgagcgcgatgctcaaattcttcatacatcttccattcttgtgttgatgtgtccaaaaactctacaaaatagaacaaaacactgtaaaattactaactttagcattcttaagataaaaactcaaaagaatctaaattcttatctttttaagtcaaaagaagcatcaaaagagaagttagataattgctattttatttaagtgcacaaactaagtatgcataacaattgtcaagttcatcatgctaaggattatagagccttcaaggaagacattcatttatatatatatatatatatatatatatatatatatatattggagaacaaaaatgaaaacgaaacgaagagaggaatcatctgtaaattggaatttattaattggtcgaagataaactcttacaaatatcttgtacttgttatgatagcaagggatgttcttgtcccaatttccgtacagtggctgatgtgatcctgtcaactttttgcatgagaaaacctctgtaggtgcatgtttacagaaaatcattgagtctaattaataagggtgtaagcactcatttgtgcttaaaagttaaaactggtttttgtctatattactaccaaatgatctgtaaggagagacaaggtggtagttgaaactcgtcatggtaatattataacactgttagttcattcttgaacagcaccaatatatataagaaataagacaggtggctttctggatcaggaaatctgatcacgctaattactcaataaacaaagtgtatgttcattcacatttgtgcattataatcctgattatttagcttttataggttgaaggaaagaggttctaggctacaactagtttgatgagaacagctaattgaatgagtcatgagtggttgtgcttgccggttatgatataaattgttggcatctaaacctattagatttcagtgttagtaacatagttcatgctgttaggctgtgttgctgctgcctttaattacaccataaaggttttaaatttcctgctgcaggttctgattttaatttctgttgtgagattttatgtttgtagtagctcacttgctccttagaactactacaaagaagttgggttatcttttgataatattaatttggtttcacatcacattatgctttatggtatggtaaagtcatacttttatttttttatttatacttttgtgaattaacagtaaattttccccttagatggttaagattagaatataaaactaacatcatttttttaaatggtcatgtgatattaagaaacttttcatcttaatcatcatatgactcagatttgctatatatgcaaacatattctgacagctagctgcaatctatctattagaaaaataagtcagacgcacgaaatgccattgaggtagctaatgatctactcaaactcttttactttgcttttgtagtataaaatttgaattggttacattaacttgtcatctatgttcgcctatgtcaactattggatctcaaacgaactttaaaacaatttccatcaattaatctacgcacttagtgatcaatagcttttcgttaattaatttaagttgtgtttacttaagcattgtgtcaacccagatccgcattattcagaagcaagatgttgtagtttatgcgtcttttgggttattggatgtggtttccacagttaatacagatcacacacgtgatttcaaacacaataagtttctttgtaggtaaaaagtatattacgataaaaaatatttttaataaaatatttaattgtccaaattatactcctgactcctctttatacttaagagttcaaataatgagtaattataaataaagttacaggaccatttttcctttatctaagttttaatcagtgacaaatatttttgagcatcttactattgacttttaacatttcaaaagaaaatgaaaatatgaacactttcactgtcagatttagaagtttattcaaactgattattttatgaagtctcaaatgataaggtgtctaaaaattggccatcaataaagctgaattgagaattaagaaaaattactggtgaaatactcatttacaataaaatgaacacctatctcttgaaaaaaaatagtataacttttgacaataaaaagtattatagttaaaacatctatgaaatagacaaaagagtgtaatttcatagagtaatttgaagtaataaaagatcaaaaagagtatttacaaaattacaaccccaggtaattaagagggaggcaaaagtaactgctaagacagctcccaaaatggcactcaaataggaagttgtaagccataatgggcctacagacaaacgaggttccctccttctttcaccgtacgtctttctctctttcactctccacaagacacacttttcttacataaacagtaattcttcactttaatactattaagcatgtttaagatgtgggtgagcacatgataactaagaatgaagttaacaatttccatatacaaacaaatgagacaccaaaaccgaagaaaagcaattagatatatattagctagcttcgatatctgtctcaacctacaacatccaattcacttctttgttaccacttaagtttgtttctgagccaagcttgtgttgttgtcaggtacacaaatggctcatgaacataatttagaaattaattataatatattaattaataatgatttttttacagtgtaatttaatttaatccttggtttttagtatataattgaaaatcatcaacttttatagtaattatttcaaaaaacttatttgaataatgtctaactagttgataggaatagcatagagatcagtgtatcaaattaattaaatttttaatctctctcaaaagtggcattgtctttcttattactactaagttatattgatgatctttttcttttcatttgtgtctggtgatcgctttaaggttcactgtttgattcagatcgtactaaagcagaatataaggttgtaacatgtaatggtgtcaggtgtgtgttgttgcagcggttattttacgtgcgataattaagaatgaaggtaacactagtatgacaatgattggtgtttcagaaacgaggcaccgttaaatttgaaattgtagcacttttagttttaagttttaacagagaataataagaggggaaagctaggtaatgctaattttcacttcaaccctcattaagatgtagtagtatttctttatctttcatcttatttatattttttaaaaactaattcacctcagtttatctcatgagtggacgtatatatttatcctttttcatttaaggcctaaatgaaagaatatcatatgatatgtagttttaactatcaaccaggattgatgtctccctctaggtctggttacaaatcaataaaatcacttcgcgatcaaattaactaacatctcattcaatttatttaaattacaaaagttcatctcatttagccttatactccttatttggaaaagaagcaaaaataataatattgaacatgttgttttttgtgctgcctaatgcttattgtaaagtctagacagttaatttaaacaagaaaacaagagagagagagagagagagagagagagagagagagagagagagagagagagagagattaagcctgtgttttgttatacatcaaatacctgagaagtggtattttcacatcaatgacatgaaagaaaaatagaagctactatttatagctcctgcttgagatcaaatactgatcgacaagtgataaacattaaaccaaacaggcagtaaggaaaaaaagaaagcaacaaaccttcagcaaataaaaattcaacttccattttcaagtacctgtatatatgtgaaagcgataaaattaaaatgacttcaatttttgagtttaatgaatatccactgttaacataaatgatatttaaattaatgtctgatgtattgatatatcattacttattatcatatcatattttattcattaaaaaaagtacccaacgtattgagttttagtgtataacttctattatatagaatacatatttttttaataagcatatagagaatacatttttttttttatataattaagcatacagagaatacatattaattattttcaacataattaaatttttgaaaaacatcagttaattttttttaaaagaactcattgattgtccatgcctaaatgcgagcaggatagcaaacattatattgattcttcttaaattttgaatttatatatgttcagatttcagatagtctgttaaaaattaattacgagctggtaagcaaaaatactgtttgggtataaattatagagaaaggtaatcccatcctggtattctggtagtcaaagttgtgctatgcttctgtgggggaatagcttacagtggatcatgtttttgttaaatttttagcattcaaatgctaattttaaatttagaactttgtacagttaagagactaattaagttttatatatacaactcataaatttatttgagggggatcaagttatctgtcactcaaaccaaaaaccaataaatacttatgccttatactcataacgaaatccattagtcctatttgcaacccaacctaagttgtaaaatatactaggctcatggaatgcaaatatctaaaatgatttttctttttcaaagtttacaagtggaaagtttttaagggtctagttagacttcaatttatgaatatccttttcttctaaatttttgatgaaataagttaacaacgttatcaatttttgaattaatgataacataaaaaattacattattattaatcataaactaacatatataataaaattgttaatttttataagattatttttaaagtgatattgaggtaatttttaattagtttccacgtgacagtataaaaatatttacattaacaatgtataaaaaaatcaaacccattaacaaataatttcttttttaaataaaaggttgaattatgaaaaaagaaatataaaaataggtaatgccaacggtcaaaatgctcttattatgtccactgtccattgtccataatgcttgtagacttgtttgcagtattgcagttgcagcagcatatggacacatttgttacaaaccctcagaatggcactgaaccaacctagacattagataggtcaaagtatgcgaacatgcacaaaacattgcaaaagcagatcccggcttaaaggtgttcccagactactaaaaattatagtggaaacaacacagtctgttagaaactatataaaaaaaaaatattaatgcctaaaaaagaagacaacgaaatttgattgcatgtaacaaaatgaccctttgtttgttattccttaaaaattctttcatcttttaagtgtaaacagtaaaaggatttaatttaattgattaaacagttattataaattttttgatatctatctttgattcaaatggataaaaaaaatatgttttgagtttttcctaaaagagacaaatggaaagacattggcagtttctatccatcaacatcgtcctgcattctgattcgcaaggttgtctgttatcagaattattggcagcagcatcattactgaggaagaaactaggaagcaaaacattgccacttagctatattgcaaagacaattttcgttgttttaattttgcagcaaaaatcttcgtatttacaattatatttaaatagatggatgaaagcaagaaagataacataaggatcagtgttaaaaagtaaaactgttcaccggtccaaacaggtactcaattcccttgaggcccacacatagaataggagcaacgacatggtaccttctttactgaaaaagaacagcgtcttaacaaaatatgcctaaggttaaaataatattttaaaaagataaagcttagaaacgaactaactttttttataagcaagaactagaaagaatgtctttggacaaaattacacaatgatatgtcaacattcttttcagaatttattcaaccgcacgtcgagcgaaagttatttacaaaaaactatatatatgacgtgcaagtatatgatactgcatgatcaaaaaatttattggttcttgatggcaaggcaaatatttatctggccgtaaagcgagatgatcggctacttggatttgtgcgattacccctaaatatggcttccagattctggaagcatccaggagtcctaacctgtgtatcataacaagaaaatattacaccttaggaaacaaagaatcacacagtctggttgtaaaataagtatatcaaacaatatccacacctttgagggcattctactggtgagatggattaaaaacagtcactctagtaacactaagttggtataaaaattattaatatccatccaatgatacagaaaaagtctttgaatctgaaattcctcacattctgttaagttttagtattaaaaattactgcgaagttatatactaccataactaggtctaaaaattgataaaagaaatattcacatgaaaaagggataccttccagcccctcttttgagcaagatggtagtatatgtcttccaatctcccaattatttgcctaaatgttggccttctgtacggtttttcatcccagcattcctcaattaacctatggacaaatcaaatttcctgaatgtgaaaaacttattaatttaatttcctacttgtggtaggttttgaaactaaacattcaaatctgctgccaattaaatgtatttaaaagcctcactgttttagcccattagcataaagctttggtgaagctctaaacggtggacgctcattttcaacatatgctttaggaacttcattttctggctttgcataaaacggtggacaaccttcaatcatctagaggaacagaaaatcatgcaagttcctgtcaatatttagctgggcatctctacaaataacaacccacagttggttgtcaatctgtatattctatatacaaaattgcccatcatccacaaataaaataatcatattttgaactttcagaaaatgaacattttgtcttcacataaaaaaaagtacgagaacatattggtaccacaacaaactgttgggcatggcatcttactaaaatgatcatgaatatatacatatatacaaacatttatattttttgggtcaatatgtggagaactcaaaatctctagaactctacctgtccattagatcaaccttaaaatatgccataaagcattgtatatcacaattatatataatatacatatctttaggattatctgatggacaaagcaggcagagctcacgtcacgaatgcttgagctgtccatagactcctatacgtatttacttgacaagtgaaagaggaatgctgaaggaatttgaatgccaaaagcaaacataggatacacagcaacaaatgatacacctctcaatgcattccttttcctgaacttccaattttttaactaacatgaacaacagagatgtatgtatgtaggggatatgactttatgttcaggattatgtaaatgcttttaattgctcaaaatataactgaaaaagcacagaaaacataaagtaaattccatttttcttttaacaaagcaaatgcaattaacagccttttaaaagttttatgtgatgagataaacagaaattacaagggacggagagtattgaattaggaaaatcagcatgcatatagaataaattcaatgatttacctcctgtaatatcagagcaaatgaaaatacatccacttttgtgccgtattcctcgtttctatatacctctggagcaacataacgccctgttacagatttgaataaattcatcaatacaaactttgaaatcagaaccaatcacaataggattaaaataaaaccagttatacatataagagatggccatatttataaatcaattgataaattcaaattagtaaaattgagcaccagctgacaactgtctttggtagtcactgagtagacagcatttcttttttccttgcagaatatgcaacacagtgcacattacggccctcatgaaataaaagttcacaatattgcttttatgcagactgacatgattgacaacgaatattacaaggttccactaaagatgaaaacttacatgatgtatccagggctccactaaagaagaaaacttacatgatgtatccaggcttgccacgggtttgtcttctttgaccgttttagcaactttaagcaacttgctaactccaaagtctgcaactttcagatgcccagaatcatcccgcagtatatttctgttgtcttactcatgtacaatgaagaaactttaaacagttccaaccattcaataatgaattaaaaatgcatgcttctactgaaaaatccatgatacttcatacacatgctggaagaataataaaatcaacaagacaggacaggagaacataaaacatacgaaggctcaagatctctgtgtataatggcttctggtttatgttcatgcaaatagttcatacccctgcaaaatatacatatattggaattattacaaatatccaaatgaaaatttttaatataggagaaaatcttcattaattattcaacttttcaaaaaatgaaataatcaggagagcttgcttccttgcaaaccaactgaaagccagtgatgcatccataatatgaaagctcttgactgacctagcaatatcaagagcaaactttacagctgttactggtttaaatgcacctttctgcttcaagtaggcacggagatccccctaaagagatgataatccattccaaattgtcagacattacaatagtgaaaaatacaaggtatagttaaccacgttatacacacaaatagaggagatatcttcctaattatatgcacttccttattttattcaccatttcactaacataaagtgaaatcccaataaacataaatggaagttctaattcagcacttatcaatactagactaaaatggttatctcttatcattacttaaaatcctacaatttagatatttataacttctagacagaacaggaacataattgtctgaccggattcagttcctctaaagtgagaaagtaagaatctaccaatcatcaatttgaattaaagcatttcgtatacataaccgactttatatcaattgtagataatccctcactttttcacttagagggccaaaccctgtctggcctatgcagaattgcaaataactcctgacacttcaacaattagtatcagtcccagtataacttttatcatattaagttcttaattattaattttttgtgcactccaacataatgctagatttcaagtagtcctattgaaactacgctagtcactttctttctaaagactatatccaaaacgataaatttctgaccacatattttattcagctcactattatctatgatagccattagccaactagccaatatgatttgttcataaacaccacgggcaaaataacttatcataaaaaatcttccatataaccagtgtaggaccaagactaacctggggtagatattctgtgaaaatcatcattggtgtgctttgtgttacagcacccaaaaactggactacatttggatgccttattttctcaagtaatgtaagctcatcatgaaatgcctttctgataaacagacaccaacaaacaaaatccactatgagaacaaaaattgagaactgaatatccaattgagtaattgacatgaatgaaacaacagattgcataagtagaccaacccacactttatcatcatcagtgaacaattcctccccaagtgtcttgacagcaacctgaattccacgccataatgcaatcctgaaagttccctaatattcaatataaaatatgaaacaaaaaataaatcagggtaaattgacttgagagaatatgtcaaaacaaggcaaaaggagaaatcaagttacaaaacaattgacaatatagagaaaggaaacttgaaagcttacctttgttatgcaaacactattagtaaaatcaagttcagaaggatcaatctcatactcaggtacttcacgagcattctgcacatgcatgggagccatctacaaaataaaaagtcctcagttgcaacttgatgtcataaacaacctatactaaaaggagtttagtatctatgcactgaaagtgtaaaaaaatccactgcagtgtaaaagcaatttaaaaaaaatacttttttaagaaacaaataggatttgtaaaaaatacttttttaagaagcaaataggatttgtaaaaaatacttttttaaacaaaaaacagaaaactaatactacttttttaagaaaaaaaaaaacagttagacaaacacatcaaaagagcagaaaactatttattttattcaaaaaagtgttctctctttaaataaacttaaacaaacgggccttaaaaatcatggtaagtgtgactcttaacgtatttattgtaaatcaaacaacctaccgtacacaacaatatggtattacgaattgtgattgaatgaaatataaaaagtttgtacagtgtcagtttatatactactttcgcttctaaaagcttgaactattaggcgaactggaattatatgtatgctcagacagcgtaaaaaaaattatatttccattcatggtaaatatgtttgactttttataataactacttaaaaaagtcataccaaaagtaatatctaattaatagacaacataaaaaatttcacaccaaaagtgcacatctatctattaatatctcgaaatgaataacatctttatttttagaggaaatgaataagatctaagaagaagagacataccgggggccttgcaccgtgtttctccaaaagcttgacaacttggtggttcttgtagtacatggcatcaactagaggctgttaaacaatccaatccagaaattagtgtcagcgagtgtagaataagagacagcgagaagagcgaaagagagtgaaattacggtgctgccccagcggtcttgtggatcgacgtgggcgcctcgtcggagcagcaagtcgacgacgtcggtgcggccctggcaggcggcgacgtggagcgcggtgcggccgtcaatgtcggtgaaattgacgtcactcccggcgtccaagagctccttaatcccgtccgagtcaccttcgttgacaagatacatcaaacggaccgccgggtccagcgactccgacgagtcgccgtcaccggcgcgctccggcgcgagggaggattggcggccgagcgagaagcgagggtggagcttcttggtttccattgcggcggcgagggttttcggtgcgagagagaatgtggattgaattgaattggattggattgaagaagggatgagaataagagagtgtgtgaatgaacattaatgtgtatgtaatgattttttggtttaattgataaaggatgggatcgggttctgtgtatgcgtcagagagtgctagttcaaatctttgacgtcaccgcctttcttactacacactccatcgaggaaggaacaacgtcggttttcggtaatgcctctctagctaacctaactaagtttttcttttttggacaactattttttctaatagtataatttaagataaaagcttagatggttaagttgactttcttacagaatttttttctgatatttttccaatgttgactttctaattaatttttttaggagattctaattaaattaattgcaacgttgatgactttttttaaggatgaacgttgttaaaactgaaccttcaccgtagaacacggtggatatataataaaaaatgagaaaataattatacatattataaaatattttatacaattattaaattataattgtttatctataataatttttttgaattatactaattgatcttactaaatactcataaatggctagtgacacttaaaagctctacatccttttataagaatataatattacagttatgtgataataaaatttaaggattgatttgataagatgaaagagaataaaataaaagataatttgaaaataaatatttaaattaaaataatgtaatgaaggtataatacttatttatatttttgaaattttttcttcacttctcaccaattttttcacaatcaaactcattctttatttttttcactaaatatttttctgaatatcagttgaattgaaaatggttatttaaaaaattattgaattattcttataaattattgaatttttcataatgttgtatttttctttcttttcatatattatacattgttggttggatccatttaataattctatataaattatcaacttttcatccctttaatcttattcttagggtgatgtgaatagatatattttttattccttttatgactttctttggtataatttgggtggaagagttaaagaagtgttttatatttagattttttttaacatggctagatttatgaatttttaaatggagagatgtatataaaaaaatgggacataaaatacactatttaaccaaattttaaaattttaaatatttaaaaacatggacccgttttctaccatcgggtcaaatcaggagctccgacaggttcgcagccatggatctacctagctgaagggttcaggttcaggttcagttcaggaaaagagacgaagattttgagcgcggaaccattgccattgccgtggccatggctttcaaccatcttcgaaacctcaatcgcatctccatccaccgcattctccaccatcgttttcagcctctccttaacgctactaataggttcttcgccgatgctgcttcttcaatgcctcaaccgcagcccaaacaacaaccttcgcctccatcatcatccttgaagcacaatgagctcgccaagttcgccgccatcgccgatacctggtcagctttcgaaacgaaagagagaatctgttcaatgaattaaaattaaattgcacatttttttttcatggggtggattgttgaagttgttgctacagtgtgtgtgtgtgtgtgttagtttgagaatatggatgacatgtatttgccctttccttggtgtgaataggtgggattctgaaggcccctttaagccattgcatgtgatgaatccaacaagacttgctttcatccgttctgcactttgtcgacatttcaagtaatcctgctctttcatttagtccttgttacctccatttttgagtctggggtgtttattcttgaaactactttggtagaatgtccaatgctttgtgctatgttataatttgattcctttttctttttctttttttacatggaattagtgggtttaaaatataatctggttgtactgtgtcagattccaagccactgttatttatgcagtcttattaaaccaatagcacttagtgtttgctacacatacatggtaggaatttggttttataccccttgaattaaatataatcgtataaggatgtgtaagaagatgactctaatgaagtatctgttaataaaaagtgttaactgaattgttttttgacacaaaccaaatgaagaaacaagaagaaaaacaataggaaaaacggtattccggttgacaatgggtttatatttttattttgtctctaacggggttctattcaaataataattagatttcacccttgtctcaggaaggacccttatagtgctaaaccccttgaaggacttaaaattgttgatgtaggttgtggaggtggaattctttctgaggtatatcttttcttcttttttcctgtgatgtttggaaaagaccttttcctttttatcttctggcctatgataaacctatagtttggtataataagttcagagatgactatatttgttgactatattacttgttatcgtaatcctcatgcgaatctgtagcattatgatggattcggaggtgactatatttggtaggttgaatacttgaattgtggaaatctgaattatttctttggtgcatattgtcctccctctcacttatagagtattaagtttgttattgtttttttattgcaaatttgtgctcttttttgttgttattttataatttatagcaatgcttctctttttgttcttcagccactagctcgattgggagctactgtgatgggtgttgatgctgtagagaagaatatcaagattgctcaacttcatgctgtatgcttattctatatttgaatatttgaaatttgtcagtcttgtcctacaaattgattagattgctgtattctgtatattggaggaagcagttgccaacattagtaaattaaatcttcactatttgccggacaaattataatctcctgtcaacagggtttggatccagcaacttcatctattgagttctgttgcacgacagctggtacatttacaaatgttgatgcattcttttacatttttgttttacatccatttttgacgtgcatgctttaagtctgttaacatttggacactactgctgaaatgccctacttatccaaatgaatgctaatacagtttagttcacaatcttgataagaagcacaagtctgactgtcataatttcctttatctaattttctgagtggtttccatggattcagacctttgctggatagtttagagtttcaaaagttacgagatcatgatgcattggcataaaaaacttcaatattttcacttcctgttggcttgtgatttcttgtttttcttacagcttgtagttaataaccattttatgttatttatcttaacttagagtcttagaatgtatctttggctgtagaaaagtcaattttttttgctatgatcttatgtcttccccctagggtcttacattgaagaaagtttttactctatcccttaatgtttctcattatacaaggtatcatacttggacatgctaaatcgctcaagtgggtgaataagttttaagctaaaagagttgttacattacatatacttaacacttcgttcatcctctctatagttggaagaattatagttttcattggcgatgtccatccaatttctttgctaggaattaggtagcatgtttgtaaaaaattgaacgctcttggtagatcagtacatgcatgatggcttcaataatcattgtaaaagtaaaagttgcttgcattcatctagttcgtttcgaattgtccttatgtttttgggtattatgcactgcattttacaactcaccaacaatttttaaattgactgatcagagaagctagttgaagaaggaagaacgtttgacgcagttatggccttggaggtactttctctttcgtgccccttacctctttctggttgtgtgcttgcagattggagtgcataaatgggtgttgggatacaaaaaaaaaaaaaaaaaaaaaannnnnnnnnnnnnnnnnnnnnnnnnnnnnnnatacagtactcagtggagttgaaggacacattttgccttgcattggttcatttgctttgaattttttagcaggtgattgagcacgtggcagatcctgcagagttctgcaaatctctgtcagcactaacagttccagatggagccactgtgatatccacaatcaatcgatccatgagagcctacgcaactgccattgttgctgcagaatacattctccactgggtattcattcttctcaactcaactccattcaacacttattttttccatcgtacattcagtcgacccattatacatatattgaactccacagcttccgagaggcacacatcaatggtccagttttctcactccagaggaacttgtcctcatcctccaacgtgccggtatcaatgtacatacgcaaaacgcattcataatttcaattgttagggattaatcatcgcattcgcgtgacactttattctggttgcattgcacacacaggtggaggagatggccggattcgtctataacccggtgacaggacagtggtctttatcagacgatatcaacgtaaatttcattgtgttcggtaccaaataaaacaacaccgaatagcatagatagataaataaataagatccgtgttactgttattactataattattattagtattgaatattgaaatttgttttgaatgctgaataataaacattaaagttataacagaaagaaataaaggttaagtgtggaatcagggagaggaggggcaaagtttcctgagggtgatgattgagttaatggttgaccgtgccatatctgaaactccggtactggacatgagaatcaaggaaccaggggtgagcaaaatggaaacggacagggaaatggagaggggagtgaagtgcatgacgcagtcagattcaaaggagaggatggcgatgccgtcgtggaagcagagaaggtccaagaatacattacttgcctttatatccctatgtgtgattttttattctggactcttaatgaagataagaaggtccaagaatacattacttgcctttatatccctatgtgtgattttttattctggactcttaatgaagataagccaaagctttagctataccaagacaaattttcttccttgttggccagtctagttttgttgtgtttgggtccctccctgtatttgattgggagaaggacaatcagttagttggttatatcaaatgtttgattcaaatggtaagtatggctaaagtttactcatcatgaagctttccaaaaagaatgcgagatagacaattgttttccatgtactcatatatcgctatatcagtattagctggtttccctccacacaacatccataaagcttaacaagattgggatgttgaagtccagatatcagtcccatctcattaacaaactcacgatttccttgtttagattttgaagaaagctgctttactgctatcgttgtaccatctgatagtaggccctgcatcttgaacaaggtgtattttttttttcttgcattagaattacacagttacacatattcaaactactgaagtgctgattggtctaacaaatctccattacactttaaccatcatgtacgtggataatttttctctttcattaacccacgaaggttatatatgcttgctaatgagtacaaaatacattacagaaattatgattaaattgtaagcgttaaattagaattgaatgtagatatagagaccatgaagtgtgtcttctatttcaaatccagtaacaaacaaattaaccataagatggaatagctaaccaagaatggaagatcaaaataccttgattacacaaccaaagccaccttcgccaactttattcactgcgtcaaattttttggttgctgctttgatttgtcttagtgtaaataatcccgtctgcagatctttgccctgagctctgaaaataaaaaaaacaaaatattggaaatttggattcaacaagaaagttaataactttctctacaatatctgccacatggttcatttcatttctatctagcatataaatatatagggcaggcaagtatactctcgtatgttctcttaataagccttgactttgatgaaatggagaaatatcatcaaattacaaatcttatatagaagtaaattgttgcacttcagttttatgacatttgaataaagtttgtagaaatattatttaaacaaattgtggaagaagctcaggcaaatactgctggatacagaaaagatgatgtgttggaaacaaattgaaatatttgttctaactaaaagaattggaagaacttggtggcatattccataccattatacactggatctttgcctcctaaccatcccatcctccttatgagaaccagctactatgccgatggccagcatatatgacataaataatttgaacttggcagctttcgagaggcacacatcaatggttcagttttctcactccagaagaactcgtcctcatcctacaacgcgccagtatcaatgtacgtgataaatcataaataatttgatttgctcggtattaatcgtcacattcacatgacactctcatttggttgcattgcacacgcatccgcccataaaatatgagttatgcataacacgatggtctttatcagacgatatcagcatgaatttcatcgcgttcggtagcaaatcaaacaatgccgaataacatagatagatagataagataagtgttactgttattactacaattattaatgaaatttgtttagtgaatgctgaataatagaacattgaaattattataacagaaagggttgagtgtggaatcagggagaggaggggcaaagtttcctgagggtgatagaggtgcgtttggattgagtcaatggttgaccgtgccatatctgaaactccggtgcgcgattaatttcgtgtttccaacggtagcgtgcttctccggacatgagaatcaaggaaccaggggggagcaaaacgggaacggaaagggaaccagagaggggagtgaagtgcatgacgcaggaagattctaaagagaggatggcgatgccgtcgtcgaagcggaggaggtcgacgtgggcgcagattccttcgccgggctggtagacgttagcgatcatctggtcgaagagaggttctctgtggaggaggtggagggggaagggggcctgggcctgggcctgggcctgggcttggacggagcggcgaatggagtgggccagaggggtggcccaagaagggaggtgttgtaggccgaagcgcatggcctggttgatggaagggtaggggaaccaattggcggcttggatggaggagagtatgtgagactggcggcgtggagagaggaagtgacggcacagccataggccattcacttctgagatggcctcccactcgctctcgctctcgctctcgctgtagccatcagaatcagattcttctgatgatgacgacccgaacacttgctccaacactgctttctcctcctccgccaccctcatcttcctttcactttctcttcccgcactcttcaattcatgccacgcgcaacttacctagctgcgccattcatactttataagcttaattaaaaactgataaatgaggttttatatttttttaagataaacatatatttttcagatcattagatctaaagacaattcaacccacaattttaacgctaacaaataaatataagactaactattctttataaatttagtttatcctatccttttactcttgttaaacaatgttacaagttaattaaataaactgtaaattaacttttaaatatcatgtcgattacaaagaattttcccactcttacttgtatgagatgctgcaataatggtggtatgccacctaaacctaaaaaatggaaacccttacttgtagttgctgttattacgctggaacaactcaaataacagtatactcatatcttttgtgatctattttttttatttagaaaccatttactctcaaacatcaatataataacttattttaatttcattcattcaatgcatgaagaaatggtttgttctcaaaatttgcaattgaagttacaccaccaacagctgctaatgtcacagcatttgtaccacttacacatgcacttagaccacttcctatccgacatgcaaatactcatatgcttgagtttcatttccaagttgagtatctccaagagtgccccagtcaagcttgatgagtttcatcctataccacgtatctaacgacctcaacttcctttaaaggggttcaacgtgttttagacatattttggatatattttgaaaagttaggcattaacgtgttttagatgtattttggatatatttttaaaaatttctattatgacattgacattgtggcatgctttggcagaagttttactactacttgggaacttggatattttatgattaatgaataacaattttatattctataaatgctcgatttagcttgatggtttacatgtatgttatcttattttatggatgattatattactagctgtatgttataatttattttgtgcattaatttatcagttaataatatttgttaaggattaatttgttgttactaagtatatatgttttggtgaaaaaattttagaatgaaattttacttatatctgttgtttcaaaaatcaatattaaaaaaatgtaataatttagtccaaaataacatgaaaaattattgtgcacatatgtacttgtcatgtgaatgaatgtgaatcatttagactatctccgataacgaagaccaaataattttaatgattagatcaaattatcgtaatattttacatttgtgaactaaataaatgattttcataatataaaagtaaaattatcaacaaatatatattttagggactaaattgagcatataccataccattaactattgttcatggttaattaggtcctctacgaagattaataaatgataactactccgcgcttgttacatactgtaaaaaattgcaataacaagtttcttaaattttgtaacatttttctcggaagtctaaactcgtagacaagattatccgttattattagttaagagcgtatacgtctcttttagcttcagaattcctccaactccaaatcctccgtttttctctctgaattccaatagttgttgtgttctgaagagagaacatgtcaagcaattcagatgcagcagcaccgacggtgcatgctcgtggtcgtttggccatgctcgctgctcacctcctcccctctgaactcactgatcacgacgccctccgccctctctctctctccgctcagttgccgccgacgaacctccacggaactttgaccgtcgtcgacgacagaaccagcaagaagtaccagcttcaggtctccaaagaaggcactgtcaaagcttctgacctcaagaaggtaaatttcctcctcatccatgaaattttcaatttcgatctttgctttccaaggaatttccaattttgcaaactgggtctccaccaattctgctcctttcatctttgttgaattgtttgcaaagtggcttttttcctattcctagttgcatggtgaaatcttaggtgggatggtttgtgattatagtatgctgtttgtgcttacttaacattgagtttagtttttatgcatgctcaatgtaaatttacactatcaaccaataagaaaccatcttagcataaaagtcaacaaacttaacatacaagtagtctgtgattgactgaaagtaatatatacactatttactcttattagtttagttattgttatgttatgggttttattggatttgcagatatcgactgggaagaatgacaagggactcaagctttatgatcctggctatttgaacacggctcctgttcgatcagcaattagttatattgatggcgatgaggggattcttagatatagaggctaccctattgaggagttggcagagaaaagcactttcacggaagtgtcctatctcataagtgagtgttctgtttcactgcaaatgtgtgtatgaggcttctgtggcgcttgtgtatgagtagataaaacattttgactgaggattcacttaaacagattttatgttattgaagacacttgaattttgggcttagttctgcttcttgttaattatgtgcttcgatatgtatgtagcatgaattcttctgaaatttattaacttgcatctttttttctgttttcaagtgtatggaagtttgccttctgaaagtcagttagcagaatgggagtttgctatatctcagcattcggctgttccacaaggagttttggtgagattttatgctttatctaaactaactcttattgtgtttttatgttctccaaatcccatccgcccttttttgtttcagtcagtgatagcttttagatttgtaaaatgtgaacaacttccactaattgttttacttcttgaaatttagtatgccagtggtattttatattgttaaagaaatctagtagctcttgaagtgatcatataaaataaaatataaagattatgttgtttgtttctttcaatggagtttgggattattaatctaactaagtagtggtatcatcttacgtttgttttgtaggatatcatacaatctatgccccatgatgcacatcccatgggtgtgcttgttaatgccatgagtgctctttctgtttttcaccctgatgcaaatcccgctctcagagtaagtaacaaaaactgctgtcaagtcattttttgttaataagctgaatttcaatacaaatttgtacattgtctatgcttcgagtccaaaggactctggagtgaatgagggggcatattagagatttgagatactgagatataataaaactaatcttgggattccttttggatgctactttttcctgtgggttactacaatgtacttgtgaatgatactctttctctaattaggattcaacattgtttattgttattgctctgttatattcctttatccagatttgatcctttttcattatttttttataattaattcagggtcttgatatttatgactcaaagcaaataagagacaaacagataacacgagttattggaaaggtgtgcttatttggttctttcttctcctttcactgttctatctctgaaaacatgcaaattatttagttatttgaatgattctagccctggttttactgattgtatcttgtgggattttgtccactatcctcgcaaccctatgattatttgttatgtgtcctactgctttattgccatatcatattttcacccctttttatttactgcagataacaacaattgctgctgcagtttatcttagaatggcaggaaggccacctgtgcttccatccaaccacctttcttacacagagaacttcctatacatgctagattctttgtatgtatggtatttttgtgcttgatcattaatttgaattaagacaaccttgcttttttatatttaactttgctttatagactaatggtagtttgagttttgctcatatataacaaatccatttttgtttttaaaaagaggtataattcaatcttaagtgatagaatggtagccacatactcgctgttttttagagttttaacttttaacccaatctccactgtgcatactttcagcggtaatcggtcatataaacccaatcctaggctaactcgtgcgctggacattatcttcatcctgcacgcagaacatgaaatgaattgttctacatctgctgtccgacaccttgcatcaaggtagacatcttactgcaatactacttaagcaatataaagcaaatataaaaccgtcatattgctaaactatatatcttattcttatttcagtggcgttgatgtatacactgctattgccggggctgttggagctctatatggaccacttcatggtggagctaatgaggtagctataagtagtgaatgaagcagtcatgatcttttatgtattgctaggttgaacgtagtgaataaacacaaacactatactgttatttaatatgggaacatgttaatgtgaccttcaattctgcaggctgtcctcaaaatgctgagtgaaattggaactgttcagaacattccagagttcattgaaggtgtcaaagccaggtggctattacagtattactttcttctgttatctagtttttactctttcctttgttagcattgcttataccctgaaaggatagcatgatacctgctctttcagcaagcagagaaaatgatagttttagttgatatttttgtcctgcatttttcctccaggaaacgcaagctctctggttttggacatcgagtgtacaaaaactatgatcccagggcaaaggtcttgagaaaactggcagaggaagtgttttccattgtgggccgggatcctcttattgaggtgtttatccattccgtatttcctgtgtctattgtctgttatattccttgatcttggtatgctggtcacgaggtctatgatcagggctgtgaatacagagaaaaactactacatttaaaaaatttcttcctattgttttatttaaatgtatttttgtatttttaattttgattacagaatagtatgcttagtgtgtatattgtatatgtttgtgcatacaagtttggcaccattgtgtctacatgcataatcattagatgtcttgtttggtttgaaaaaaaatagcagatcaagtcaaatgaagatcttaagacattaaaaatctctagcaacacctttcatttttcaaatttaaagtattactagggtttctggcactatttttccctgaccaggaaagtacctatgtaatttaatatagattggtcagtatatggacttcaaaagttctaacttctgtatgtaattatttgatcgttcaggtggcagttgccttggagaaggttgcactatctgatgaatatttcatcaagaggaagctatatccaaatgttgacttctactctggattaatttataggtaatccattatttcacgcagttattctaacttggaggancaggtaatccattattacacctagttattctaactatggaggataaaatatgtcccctctcccccccaagaataccatacaaggtttgaacaaatagttttatgcaaccagggccatgggatttccaccagagtatttcactgttttatttgctatccctcgaatggctgggtacttggctcattggagagagtccttggatgatcctgatacaaagattttgagacctcaacaggttaatttctttctttaaatcattattcttgttatgattttcttgcatattaaaattatatcatgcttactgtattgtgctaatgtagctgtacttcttgtgtatcacttgttttactggaaaatggttttcaagttgtatcatggctgcattatatttcttaactgtggtactgggcaatatttgcgtaatgcattagaactgtatggtaaacttttagagccacctataactaccacactcgtcaattctacctgaagatatacaacatgataagaaacttgggagaaccacatgataaaaattagcagttgtagttggagacacggccttataactctataccagaatcccatacttccaatgtgggattcaagtcccttatcttgcaattgaatccaaacatctcatcacactttgcagcactttgattagttccaggtgaacactgcaatgtcggcatcacgatctccagtgcatgtttgcagttgagaacatggtgaaaccctctgataccaatcaataagaagtttgagagaatcacaccacaaaagttagtcattgaaattggagagtaaaaggctttataaatcctacactagaactagaaccccatatttccaatgtatgacttaagacccaataccttgcaattggatcctaacaacatgtgacgcctttcttatttcaatctcttgcctagtttcatcatatctattttatgcttcaggtttacgttggggaatggttacggcattatacaccagtcaatgtcaggactacatcaagtgatgctgacaagcttggtgaggtggccatatcaaatgcctcaaagcggcggcttgccggatccggggtatagcttacaggctcaatttagttatatgagcaagatgaccaaaaggtgatatataattctcacgaacgtaaataattctttgttgatggctttttataatccaaagttaactttgctatgatcaggatgacatgtctgcataaataatgctactggtgtcacatccatcacctaccagaagaacgatgctggtgtgctttgttaagcctttatgtgcacgtcacgtttcagtacttctactttcaaattatttgttaattgttacaacggaataataaatagataagcatagtttacatatctcatgggagcagtaaaatgtacaattgattagcaaaatgtttgtgttaaagaaataagagttttctgtgtaccagtacaaattatttcttccccctcccccctatagttgggtgcactaataaagaaaatctgctgaaattcaattagcgttttttttcctctcaatatttcatttggactacgcggctaataatctatttttttataaatattttattaaaaacattttaacaatatatcaaaagaaatgttagtaatatattcgttaacatactttattgaacactttttttatcattaattaatattttttttaaatcataaaattttgtacgtctcgctttatttaatgacttttacacataattttgcagctttagataaatttaagcaatagagactttgttagcaatcctcacatgtcaacgtaaattataactaatcttttttttaaggcaaaaataagattactgaataaccctatatttaaggcaccccaatgtgatgggaatagttccataaccatagctccaaactatgattagggattacaaagtatacaactcgtcccgccatgcacatatcatatatataatattttgtgaaaaataattatatttttatgataaaattctaagtctttaatctctaaccatatcactattagagagtgaaaaatactaaacttttaattagaatttttatttagcgattaaaatattaactttagctatcactatgttgtatgttattttttattttctttatttatgacttgagtttggacgaattaatgttatgtttgcttgttttaattaaattatttttattaatttattattattattattattattaaccttatacataaataatatgcgagtcacgggtgcagatatgagtatatataggtatcaaacatgtacgaaaataagattaaaattattacctgcaagggtatgagaccgggtacgggtattatttttaaatgtatagaaactataggatcttacctagacctacctattgtaatccctaattatgacaccccaaattttgtgcgaactagcaacaagataaaactctttatattgttattaattttaatttttttttctcttttcttgcattgaatacaccacgagttttgtattaaatatgtggcattaagaaactaatttcagttgtctgatccatctgaattaacggttacaggatgatagctcttttctgtttcaacatgtgagccagaggaatcagtataaatactaggtattgatatgctatgtgttccgcttggattctgccagaagtgacttcttatactcttatgtttggaacttgaactgatagctgaatatcccggatccgaaagtagatcttgaatatcagtccaaccttcaagcatgctcacaacttgggacattgttggtctaagtgtaggagatgcattagtacataagagagccacatttagcaccaccatggcctcctcagttgaatattctgaacccaaatttggatcaatcagctccagaagactccctctctcttgcaaaacatatgcctaatgaaactcaaattttagaccaaattgatactaaaactctaaaaaagatattacaatatatatatatatatatatatatatatatatatatatatgagcaattctagacaaataactatacgttaagattaaaagtgatttaacatttgccgataaaaaactaacaactaacttttgacgataaaaaaaagtgatttaatgattacatgatcactgaaaaaagacaactttgtgatttaatcttttaaaaaaatccctctcacttgatatgcccgtatatgcatgtgtgtatgtacgaactagtaaaatcaataatccataggtcttggtaatttagtatctattgtttgtttgagcctgttatattatgcattaagataaattctaattacccaatcaagaaggtaaacaaaatcctcgtttggcctgaaatttgtattgctctttccactgacagtttccagtgcaaccaccccaaagctataaacatccgctttgtcagttaaatagccacgcattgcatactcaggagccatgtaaccactgcaaaatgaaaaaaagcatttagcattgttaaaataatggatttgactaagagtatactttacagaataaagtacatcaataaccatgggttgaatatttaatgcttgaaattataactaacttcatagtatgatacacatgcatttgatttttaccagaatctccgctattgattaaaaatgggtatttttaccatgttttgatatgaaaacaagagaaatagtagcaaaatatgaacttacattgttcctgcaactcgagtgctaatgtgggttttgtcatcttcaataagttttgccaagccaaaatctgagactttagcattaaaatccttgtcgagcaatacattacttgccttaatatccctatgtatgatttttattctggactcttcatgaagataagccaaagctttagctataccaagacaaattttcttccttgttggccaatctagttttgttttgtttggatccctccctgtatgtgattgggagaaggacaatcagttagttggttatatcaaatgtttgattcaaatggcaagtatggctaaagttcatcaagaagcttaccaaaaagaatgcgagatagacaattgttttccatgtactcatatatcagtattagctggttgccctccacacaacatccataaagcttaacaagattgggatgttgaagtccagatatcagtcccatctcattcacaaactcacgatttccttgtttagattttgaagaaagctgctttactgctattattgtaccatctgatagtaggccctgcatcatgaacaaggtgtattttttttcttgcattagcattacacaggtacacatattcaaactactgaagtgctgattgatctaacaaatctccattacactttaaccatcatgtacgtagataatttttctctttcattaacccacgaaggttatacatgcttgctaatgagtacaaaatacattacagaaattatgattaattgtaagcgttaaattagaattgaatggagatatagagaccatgaagtgtgccttctatttcaaatcaagtaacaaataaattaaccaatggaagataaaagtaccttgtatacacaaccaaagccaccttcgccaattttattcactgcatcaaagtttttggttgctgctttgatttgtcttagtgtaaataatcccgtctgcagatctatgcccctgagctctgaaaataaaaaacaaaatcttggtaatttggatttaacaagaaagtttataactttctctacaatatctgccacatagttcatttcatttctatctagcatattaatatatagggcaggcaagtatactctcgtatgttctcttaaagccttgactttggtgaaatggagaaatatcatcaattacaaatcttatatagaagttaattgttgcacttcagttttatgacatttgaataaagtttgtagaaatatttatttaaacaaattgtggaagaagctcaggcaaatagtgctggatacagaaaagatgttatgttggaaacaaatggaaatatttgttctaactaaaagaattggaagaacttggtggcatattccatacctttatacactggatctttgcctcctaaccatcccatcctcctcatgagaaccagcaccagaagaacaaccactaaaacaccagctactatgccgatggccagtatgacataagttcttttgccatcccctgatggaggtttaaaatctgtgcaagggaaaaatatttacttttagcttttgcataaatgaagaacaaaactgatagaactggatcagataaaaggaaagaatgatgaattttattgataacagaactctagtggaggtcttgtagaggtagacattaatggtaatctttcccttttcctacaatttttaaattcataatggattatggtttcaactgcagtcttatcaagtcagataaagcactaactctaagatgcatgatatgtgacttactagggtttactgaaatagcagatactagaggtccataaactcctcttgtgggtatgccagtggttccttttccagcccagtagaagtgaatcttcaaagtatgttgggtgacagaagcattaaatgtcttctcaattgacttgccagtaccaccagcttctcttcggatatcaaagtctttcagcactaaattccccttaattttaggacataataatatattcaatatacatcaatgcacaactcagtgcaaatcaattatttagcatcatttgcaaatcaagcaagtaattgttacctggatatagacgtcaaatactcgccttccaagactgttaagggacctatcattgatgaaaataatctctgcaaagtgaagcttaactgtgtaatttccatttattaggcagaggccatagtatgtgagagcaaggggagaaacacgtgctgttgtgtatagttgtgaattgagtgcagagacattaagtctagaagtattggccacaatatatggatcagagtcaatatcattgtccatgaagtttccagtgctactaagagcccaatcctggctagtgtaatataacattgcagcacccttttgttctctgtcagcttcataaatattaccactaatatttgcttcgtttccaccacaattaatgttcagggagtactgatctattgaaaaaacaatgacaaacagggttgaaaagaaagaatactcagtgtaaaatctttcaaattgtaatggtctaatggtaaaaatagacaactgcatagaaaggtaaaattcgcaaagaatgcaacatattcaatggttgtaataaaaaagaataaaatgtcattacaatcattcaatggtggtaataaaaaaggatatcaaattatcttccagtttaagtttcttagaattagtcaacctatttatttcaaataattagaaaaggaggaaattagtcttaaccccttaagaaaaacagttatattcttgtttctttcctaatggacatttattccttcttacattattttgttttatttgaatttctgtacaactctgagcttaagattgttagcaaagaagtaggcagtgaacttttgcgtaaatagaatcataagcaaaatcatgttatatgactatcttaaatttttcttttggtatgaaatcatgttgagttgaaagttctcatcaacttatttcactcaatttcaggtcacagaatttgagtcaatatttaaaccagcccatcagatcataaaagtaatttaaaagttgtagtatggtcacatacttacattggctaactgaagcagggcatggaaagttcctttttaagcatgaatgaatcttatttctgcaaccaagagagaaatttaaggttatattctagggctactaccaaaaaccaaattttacagaaaatattccaaagacaacagcttactgtgtatttacagatgaagagtagctctcaacaaggtttctggaaaaaaaaaaaaatgttgcagtgataactgataactaattgaagacaacttttactcaaagcttaaataaactaaaactttacatgctcccacgttgacattcagttggacttgagctgtcccaggagaagttattgtcagagatatcactgtgcaccaaaatatataataaaagatgttaatctcatgttgctaaaggagtgcttatttaatttcagatgcagacatcaacagcttgaagatgccagagaacataattttaaagaccgaaccagtgatcgatccaatcaagatattggatcaatggttgaatcagtgagccatgaattaactcacatgatccggtctctgttatttttttttaatattcattatatacagcttttaaaattgtaaaatttaatattattgaaaattattttttaacctctattgttattatattatattttttgtcatatatttcacctttttttaaaaaaaaaatctctctttctttatttctttttattatataatgtaaaatattaatttcaattgttgacagtacaagcaactttaataaatgaaatttatatgtgggatttgatatataaaaataatttgctgcgtatgtgacaaaaaacattagatcagtggttagtatagcttaagggtcctgtgagagtgtgaggcatggtttcgtgtcccagtcccttcaatgttaacctcactcatttcgttcacatgcactcggtggcgcatggtccgggttttaaatagagagtataagttatctaactatatatattttttcattttctaaatggatttgttgaaaaaaaattctcatgatggaacttaatataagacttgtcttcttgttgttgaattctaaattctctaaaacatatcaatcacacactacacagtgtatatttctagctgccttattcactgtagccactgaagcaaatattaagatgaagactgaaaattgaaacataacaattcaagtatttaacgtacatatttttgttatttgcgaggacccatcgaggtatgatccctgataatttgttcccggtaagatacctgcattatttaatacattttgtttcgtcaaaattaaaaatgaaatgtatcaataacatattttattcaacgcatccacttacatgaagtctactttgtcaagttgggcaaaagattcaggtatctctccactcaagccattgtaactcaaatctctacagcaacgaagataaataaataaacttgttttatgtaacgaaagggttaataattttttatattataaaaaatgtattttatcttcaactttaagatgttcataaatataagcatgttctacattttatagctgtctttataatcttccttcagtattattcaaacaaagtgatatggtgttgatgtatagcaaggtctatgatagaagttcataagggacacatgaatcatcagagcaacaaccattcaactttgaaaaattaatctacaccggaaagactatagaaatatctgtttcatttttgcttctctcttaatgaagtttagtgctagttagtaattacccatgtttcacggctataaacaaaataataccataactgacctacaaaaccttgtacctggaaaaaaattatatttcagatctagataaaattatagaacattattatgagcgtagtgtcaatattataatttatatgaaaacatggcttagccaactttgaattgattctatgagatcttctcaagtggaacatgatcctcaaagtaatatatcatgttgtcaaaactgttgtaagttatttgttgaacaacttacaagattttcagtttttccattctcccaatatattctgggatttctcctttaatcatgcattttctcaataccctgcattatgtgtccaaataaaatataggtcatttttataaagacttcaagagaaagaagcatttaagtcattgaacttacagtgtcttcatggatttcaagttatttagtggtggaaaagctgagcgtttactagcttttaggtcagttatcctcctaagcatcaaagaataaataaaacaatcacttaacatattcatcttctacgaccaaaacataaataaaataaagaattacaaacatacaaatcacttaatcttgtcaaggcagaaatgctagatggtatgggaccctcaagagagcaaccgtgcatatgcctgtaaccccaaaagaaaaaagttaacatgataaagtagtctatacaacaaatacaacaagaaagaacgaggtaggaaacttacagcttttcaatcaatgtccagttactaatgaaatcaggaatcttcccaaggaaattattgtcacttatcctcctaaaatgtgtttcccaaaggttaatcagtatgcaaggaaatgtcaaaatttaaatgtaacaacaataaaagaacaaaagtgataaacaaagctacagattctttaattttgtagctccttatatgaattgattaagaaacttgcagtgacttgcattaacacctcactacctaatattaaatagaatcaaagtgactcatctttgtgcatctttaactgtcagattgtaaccatgtgctagaatatgtcaaattgataagaacttacaaatcaatcaacttggttaacttggaaagcacgggtggcaatgctcctgtgaatccattggatgacagaatgctaaacaaacatgatttactcatgttaaaatactacagaataatatgtgagggggaaaatagaagcagatattgagattccaaatttccaataagcattcaaagaagatcaaaagaattacagtttttctaaattggtcaacttcccaatctctgttggaatgtggcctgaaaattgatttccttcaatactcctgtaacattcatacaaatatttaatttaaacaaagctgcagaaataaattggaaattatactaaatcaacaatcctggatcacctatgccaagcttcctttaggtaaaagcaaatatatcggcaaaaggtaaaagctacctttagatattccaaatatatctttcacttcttttttttactttctatttttctttaaaaatacattcaatttatcactaagctaagtgatggagtaaacatacaattcatttgaaaataaagaaatgatttcaacatacaagtttctgagggttgtgatattggtgagaactttggggaatggccctgacaatttgtttcccataaaagagctgcacattcaattcacaagaatctttagtgtcactctcaagttgtttactgtatacagaagaaattgaagagacaatgcagagaaaccaaagggtgcaaagcagaaagttcttacagatcaaccaagcgcatggtaccccattgtggaggtatagaaccagtgatgatgttacgactaaggtctctgtttgaaagtgcaagacaaagttagtggacttcaccattccatagggaacatcatgcagagcaaaaaaaaaagtcatggtttcaaaactgagatttgatatcttacaattcttggagatgatgaagcttggaaaactctggtgagagactaccagacagattctgagccttcaagaatctgttcatttagaatatgaaataaaaagcagaaattcagaatttataattatatggtggttaacatgattattccaagatatccaatcaataaacaaatacagtacatgaaatgagaaaagaaacaatctagtgagtcccttgtgtacaaaagttaggaattcctcacaaacagattaaatctaaaaaattaaccaaagtagaatttagaattaattcaagaatttaattagaatgtattgacagcaggaccgtgtttaggaattttagggcattagtcaaatttttaaagaaacttaatattatataaattatttcttaaaataatttttttagtttttggtgactttttttttaccaattaaactcatttttatatattctttttatgaatagtaagacatttataagagtattatatattgagatttttttaatttatttttattttaacttttgaaaaccaagttcctactttctatttgattttttcctattactacaaatataagaataaaataaagaagcactgaataatataaacaatttttttataaaaaaaaatctgatatcaattaaggtattaaaaaaatatgaaaaagagataaagaaacaatgagaacgttgaataaatgttatttttaattaaagaaattgataagtcatgcattaatatctttagcccttaatgctattaaatttttctatctctaacattaataaccatgttcctaattaatggtataatttcttataataaactacaaattcaatttttaattatatatataattttggtttttagttttttcacctctaattgttaattaagacaagtagttaactaacttttggataattttctaatcataaaacatcattgtttattgtaatttgaacaataaaaacagatttatataaaaacttacataataataagtaaaataaaattaaaagacctaaggtaatattttaatttccttgtaccagccacgatcttcgaccttgattgacaatattaaagtatcttacagtatcaaaaaatcatgaattgttatgaatgttaaaattgttgactttcgtaattattatctaaaaactaattgtgttatctatgaaaaataatactacatatttttggtcattgacatgtatgtgagactagtgattagtaccccttatgtggtaaccatcaacactcaacagttgatctagtgttcagtaaaccctttcccattctttgaacataaattaatcaacatttcctatttaaaaaatcaacaaattactttttactagacacagttcgacagtaacaaaaaaaaaaacaattagtttgaagcaaaaacatgaacgaatagcccaacagatgaaaattaaaaattttaagaaaattttgacgagaaaaaaaagataaagacagcacatcctttttaaagtcaaagatttgcaacttgcatcaggtcggttgagttgtcgatccgagacccgtgtccgacatttcaaacttaaatttttgtatgttaatgagttctggtacttaaacataatgaaatcaacattatacatgataagtatataattaatttttgtctctctcaaaaaaaatttgtcagttacttttttatttttttttatttttctggtatacatttattttaaaaatataatccaagaaacattttcctctcttcaccaaaaaaaaaaaaaagaaacattttcctcttctcatttagtgctacgcgttactttgacgagtcacaaccacaaatgtgcatgattaagattcgcgacggtcaactttttgaagaaggcagaatatgcataaatctttggacatattctaggtaaaaagaaaattagtagaaatacacccattaccattttcttcctttttgcttcaattaaaaaggttcttggaatccagctatgaaaacatgaatttataactgaacaattttttttctcgtaaaaaaaaatatgtaactgcacgtgaaggtttgatggtaactttaggtgctgtctgtagtaataaataaaaatagttgaagcaatatggccgtgaagattaattaattaatcaaaacttgaagaaaatcatcttcattttcctaagtgcacatgtgattccatgtgattatcttccataatctgagttctcgaaaacacaaagaataccaaaaacttgattgaaacaaattaaaagagagagaaagagcattacatgcttacaacatggcaagaagaattgtgattgaaggaacaatcacatatcacagaactctcaaagcctttcctagcatcagacacattccaattcccttttccactgcaaggatccaccccaaagtcccagtctttcttcccaatcttgcttcctatttccttcaatgccttcactgcacacaattcaaccaaatcaacttcatcgatcagagaaaaagcaaacaacattcaaatgagtcttacggtaccacagatgcatatgcatagaattattgaattagaagctatgatgaaatgaaacaaccaatccatgattttcttttgctgtccatagatccaaacaaaagaaatgagtgagacaaaaccacttttgactctgcctcaattttgcaactctatgttccgatccaaaacatgggaaagcagaaaggattataaactaatgttatgaagtatgaactgatttgatacaagtataaaaagtgtgtgaacagcaatgagtgaaggaatgagttttaccctcttgagtgttgagcttgggagtggctgcagaagccaagtgtgagaggaaaatcaatgaagtggaaccaaggaggagtaaaaagagcatcttggaataatctaagttggtctccatgaaagtgttttcactctttggttgttcaagcaggaagaaaatgatagggagtgagtcagagactattatatgctatcagatgaggatagacactgggttgcataagtggtgatgttagtagagtctgtactatggtcgggagcatgtgacaaaaaaaaaacaaaaaactatgccaaacccaatatgagtatttatattgtgcattgcattatttttttttttttgttgtgaaaatatctgtaaaatgctcagttgcaacttgatggaagacaacttggtaaaggatccagagttaattccgatccttctgatgaggggttaatgcctcttatatcttgattaacaaccttcctaaaacagatctcttaatgtagaagtagttgaatagtcttgaatgaatcaattaaattgtttgtggtttagacttatatagtaataattttctggtgagtttctgctaatagttttaaaatgtaatttaccccccacccaattttattactttaaggatagaccacccaaatcaattttattactagctttaagcacaaaccatcttacccaattttattactttaagcttaaaccaaaagaagttacaaggaagaacggggtttgcaatcctatcgcgtgggaaacgtgcgtttgagacgctaaggaaaaagctcaaagttggatgtgggaaatgtgtatgcaaacattaattatagaattcggattggttgcgttgtggccatatctcgatatcgcttgccttcccagggttaaaaaagaagaaagaaaaactcctaaaatttagattgagaatatttaaaattaaatcaagtctcctgttatagtagtataacttctacttttttacaatttaaacgtaactaaaaatttattgttgtgatttacatttgtgtggataagaattaaaacagggtaaataattcacaaaaattaaaaaaaaaaatcataagaatcaaagatactgagaatttataacaattcatatattttgtataaccaattagactcctttggttgtaattttcaaatttgtaataattaagaaatgagcaacatagctcgaaatgatgagactagataacattttgttttcttttttcaattttcacaactccctcgagcgtcgtattgcattgcctccaacatttatcttcaattgaaagaaaagcacggtatttgatctatgtagaattgaccatcagaattcaacattagaataattggatctgttaatttaatttggaagtgttaaacgcactacataggtttgcatctattcatgattcatgtatctttgttatccttattgttgattcttgatttaattgtatatttaatattttaattgaatatatctcaacctagctctagtccaaatttaacatattttaattttgtaaagaaaagaaacttactaaaaattttagaagaaccaaattcgaatatttttttaattttatgagaaaaaaaatcatatttagcctaaatttaaaaattgattttagtttctacaaaatttaacgtctaattttggtcttcataaaattcaaaagcttaattttaggtcctcataaaaattaaaaagttgattttaatgctcataaaaatgtaaaatattatatttttatttttaatatagtatattaagtaatattaaaaaaataacaacttttatattcataactcaataattattcttttttatcctaaaagaagagttacggtgacagcggcactagaagcaattttgacccaaaactagctcttgagccaacaaattaataacaacttttttctacacaaatctttcgttaatctatataattgtattatatctttataactaacattcataaattattattttattcctataactattttcacaaatcatccattaatttttattatctttctttttattttaaaaaacatagaaaaatagttaaatatgaagtatccattttcttctaatagttaataatgttaatattacttccttcatttctaattataagatacttttcagaaatttatttgtctttttttataaaactattttctaatttttagattcattaattttttttacatatccttaattattctctcttaaaatattaatgaaaataattaaataattagagataagaaaattataattttataatgatactgtaatgaattatcagatttaatgtaattaattaaattaatcattttcttaaaaatataaattaattaaaatgattttataactaagaattgaaaaagtaatatattacattaataaatcaagttgacctcgtccatcttgtcccatctattattgggttttaatcgaggggtttaaacttacataaataaccttaacaaagttttaagatacgtagaatcaaacatatatctgtcgcaacccatccatggtcattcctaacaaagttatgaatattatgttgtttttttcttaatataatatattatattaaaataaaaatataatattttatgaggactaaatatcaaacttataaataaaaatataatattttatgaggacaaaaacccaaacttataaattttatagtaattaaaatcaaatttaattttttaagggacaaaaaaaattctcttgtcatatgtgataatcatgtaccgaagtgaataacacatgatagatgtgtcattcaaaatgttccctaagcatatttttaatgaaaaaattttaagtgagttttttaaattattttttgtgatttttattataatgtcatgttatggtaagaaattcatacacaaatttatttcaatggtaagaaactctaaaaaatttcaaaaattcacatttttatatttttttcacttaattataatttaattatggtgttgttatatgtcagataaatatttttattactaagaaataatttattgtataagatacaaatcttatttttgatgaactctccttattgagtaaatttgttccaatgaaactataataagaaacaatttttttacttaaaaaattcttcgataaattcttattaaaaatgttctaatacaatattaatatggaactttattagtcataacaacaatccactaatattagatgtttgaactaaaattaatacgtttaaatttttaggaactaaaataagacaatattataaaaaatgaaaattgaacttctactattttcaaaggatgaaaaacatatagtatttatcttttttttagggaacattgcaatgctatgaatgcaagaataaagggaaaaaagttgtttgtaattaaaaaaaaaaaaaaaaaaannnnnnnnnnnnnnnnnnnnnttccaaacatttaatgcaagccttatatgaccaagacatgcatgattaacaattttctgctcccaaggaattataaattagaacacttgaagaaatatataaaaaaaaaggagacattttttgtccaatacattcaaattctaagatactatatgataatcatattaaaaaaatcataatcccaaaatctttttgttctaaaatgtattatttatctctatattataaaaattgattaaaagaagaagaatttctttatatattttttatttatgcaatcacaaagtttctttagttggaggtaatgaaagataattctgtgcaagaatttctttaattcgcacgccattgcaaccgtaattcagccatttcgatgtggtcaaagtccatgctccaataatctttcggctcggtgggaggggaagttcaagtcttaagcagcgcaactgcgaggtaaaaaattatttaaattaatcataaaaaactttatttaagtttaattcggttgaaaaatattaaatttaatttaagttaaaccaatattttgtaatttgaattaaatcgatttttccattaaaaaaaattatatcgattttttattttctattttatgaagtagcaatactcttaatttggagatctatagaaacaaatgaaaattaattacaattaagaaaatattgagcagttaatttgacctaatggaacgataactgccaagtattggcatttttccaacctagctttatcattgctggattgagactcctgactcctgaggagattattactttataataaacatcataaagtattaatatttaagtttttaaataattaattgacaagtgtaaaagtattttttttcctgtaaaaaaagtgcaaaagtatttataaagataaatacagttttattatctgaagtattttttttgttttttctattgaaaagtttaggtaagttggatttctcatcaatgttaagtaagtcctaagaatatatcaatgttaagtaagtcctaagaatatttatagagttacttacaaattatccaccaacaagattttcatatgaacaactgaaattaaactcacatccttttataatataagtttatttcttatcaattagaccaatctttgttaattgtttttagttttattttaactttttaagtttcaaacatcaaagaatgtttaaatacagatagtaaattatgcttaacaaaggacatcgctaaaataaattgaatgggatacacatgtggattaaatgtttttttttatgagtgaaagtgatataaatggttaaaattataaattaaaagaaatatttaaattaaacttaaccgaccctcctttagggtgtacacggattggtttggtttgagtttgatgaaatttgtaatccaacctaattaaaattgaacggattgatttaggtcaatttttcaagaaaaaaaataaaactcaatccaaacgaattcatttgtaaatagtttgacttgggttaacgggtcaaatttgtctattatttttaaaatctaatattttttataagctaaaacctttattaaatgaaataccaaatattttacttataattattacttgtactcaaatagtggaagaaaagatcaaaagaggaattacattctctcattatcatcacatatgctaacataatatattaaatatgatataaaaattgaaatataataaacaagttcaagaaacacactcacaaagcctaaaaatccaataactaaaactatttcagtataatttgaaaatttcaatgttatcaaataatcaaatcgtgaatagtgtaattgaaatttcaactaaatataaaatagtttgaaacaaataaaaaatcaaaatagatattctatcgacacctaggagttgaaatcctaattttgtgagagtgacttagtgaaatcatgagaactgaaaaaaaaaatctcattcttaattactataagttttataataataataattgattatttaaaattttaaaatattatatatatatatatataataatttaatataaattaacgagtcaataggtcgatcaacaaataagtgattctagatattaaatttataattcaatccaaaattaattcaatgaagttgaataagttagatttgatttgacaaaacacaaaaaatatctaatccaaattatttgaattgatttgaattatttcaaatttgccatgacttgctcccctcctacacatacgtataaaagtctacctgaaaatttatatctgctgaaaggtaaaatttaatatggttttttttttttttttactattgcaatactagtagttatcttggatttatagctagctaatggtggttgaccagggtttgaagcttgaaatgttacctttaatttataggtatgaaaaggagttgaagatcaccttcgtttgcttgcatttgacgttaagtagacattcatatgtctcaactttcgaagggttgtcaacaccgcgcgaggactctctctatcagcaacattcttctccacatcttggaaactctttagactttaatattaatattggcttgttaattttaaagttaaatatatgtattttttgataaaattattttaaatattaatttgtttcaaaagtaaaacaacgtactcttttaattagcaactaatttttcaacatatatatatatatagctttttgtatttttttttctgaacttgagattgacttaatcacaatcatggacttgtccaaacatatagctacaaaaatattcagaatccgcactgtttcttttccaatgtcctacttgtgattcttgataaagtaataatgacttgcatataactctcaacagctaccagaaggataatgattcggagttcggaccaagggaagaagaaagtaacatttttgtgtcgtcttgcattggaaatttggaattaaggaggaaagggagatagcgtgtggggacacaaaagaaagaggcagaaaataaatagaatagaacgcgttttaatttaaggattaaaatacaaaagaaagaggctactgaatgtttaatgctcaatgaagtctcacgtaccctgtgagtgaaaagaatatcaattctaactcgaccattccaaattataattttgagaagaattgaatatgaatcactttataaaaaatgatctataagtttgaaccaaaactacttttataaagtaattcagtttagttctttaaaaaaaacttaatgatatatgtatgaggaaaagaaaaaactaaactaaacaccgaaccaagttaaaagttaaaccagctactttatgatgaaaacaattttgttcaaaataaaccattttaatagagtgatttgattcgattatgggcagcactaatctacttaatgttgtgaccttggctgcattaatgaattggagattgatatttttcgtattcatacgtacgtgcagtaatctaaatcgagagagagtgcatgaagttgactgccactacgtacactgcaaatgcagcattccattttggactctacaaagtactaactactaccatgcttcttcttttgacccaaattattaaactgctacttccagctctaaatttcttctggattcattcggtacgcgctatttccattttttgtttttataatactaattaaaattaattattattgtttcgtcatttatcatttctagaagtcgtactggtattttgcattaattatatttgcttgttacaggaagcccatgaccaataatgaatggctgggctgtaacattaagttaaattttaacatatatatatatatatatatatatacatatatatatatatatatatatatatatagctgtttctgttataccgatgcatacaactacgaggtagcgctatatataattagaatgaatgaaaaaaaaagatttttgaattatatttaatatatattttaaaaaacaggatataagattaaattaaagttaattgaaatggtgaaattaaaaaaaaaagtttatgtttatgcattgttagtgtaaaaacttttatcagcggtactaattttaattttttttttttaaataagtaatgttatataaaatataggataagcgagtcaattcatttctaatcaatttggcagtcctgatccaacttattgagtatgatgattattgtttgagtgataatattttaattaatctcagctaacatattggttttaaattatggatagagctcatcaatataaaaaattgggaaaaaaaataactcctcatccatccactttctcgtttaagcataaatgcagaacaatggttataagattttctttttccaatagttcaaatgacaatgaatttgaattatgttattttaagttagattttagatttgagttttatgaataaaaaaatatgattgagagagaaaaatcccactaaaagatggttgatcaaattttttaatgtagattgatcatctataaaattaatagatatttggtattaataattttcatttgcagacgaagctgcgagaatgtcgtttacaatatgtttatggacctggtttataagtcgaggcccaataaggtaatttagaattctcatagcccatgttattttcacattccttttatttaagatcagaacttattttatttgaaaaatagtaaactatacccaacctttcccttacatcttcttttttaaaggacggataaccactatagtcccttaacatataagggggtgataatttaattcatgaaaaaacaaatttttgaaatagttcatgaaaatataaaaaagtgtgtaaaaatatcatattgttgtgtagaacattaattttaatttatatatctattttgtgtatggatattattaagttataatgtttaaggattattttaatattaaattataatttttgaagatcaagttaacattaaagattcaaagattatttgacgtgggacgtgaaattgatgatgatttttcgcactttaggtttaggattaattttaccctttttatcgacccttcttttcacaattaacaatttagtggattgttaattttaattattggattaatttttttatcatttatataaatttatgaagaaaatattatatattgttattttagtttgtgaatattggttgtttaatttgagtttattatgtgagtgtgtctataataggttggaccatcacatgatatcaaatgagacatcacttatctaagttatctcgactagtaattataaaattgtcacccattaaacaattttggatgatataatattatgagaaacactacaatgtaattttaattaaaaataaagaaatcggatgaataaagactacatgatcctactaaactaaacctaatcatcatccaaaatagtgagcaataagcatgatcggtgctgttgcaattgctctctcccactttgaacgttgaaggaataaatattgtcattggctatggcagtgacaccgacatcaaattatagaagaatttattcttatttatattataaattaaaattcatcattctcttaattagatattttcaacactttcttttttcttttttatataaataataaatactaactttgtgagtttcagaatcataccccctttcagatagaagcatgagagtatagagacctgtttgaaattatcaaatatgattgatacttggaagtcgacttcaaccatgtgattagtttaatcatctcctacagagattcatccctcaatgttctatgtaaccttttttacggtatggtgtattaatgacttaataaattagatttcaaaagtggaacgtagaatgaacatctcacgatgcatcaggacattttctgcacaacaattaagttgtatatgaaatcaaaattaacccatcatctgctcattacattacaaatatatatacggcatgacatggctcatgcagaacaatgcccatttcttctccatctatatgcacggggtataggtatacgtatacatatatgtgctacaaatcaatattgctcagtcatactcaaactttaggaactataatttgtagaaatccatccctgaaaatggggaaagaaacaacaaattatcagcttcaaatgtttataggtacagcacatatctttgaacttgtgcaaaaccgcacacatcacatactagtccctgaaattattcaagtcactttcgaccccatgcatgcatatttttaaaataaaataacatgaagtcacatacaaattcagtaaaccaaaacaaaaaaagtacacttattttaagctatatggggaaaccttttcagttttcagcagagcagaatagaggagaaaggtaggggaaagagttccccttgagtagatgtgataaattatatagcttttacattgagttgaaaaatttatgaatcatcatggcagtattctagcttccaaacaaagcattaggattggcatagtattctagcttccaaacaaagcattaggattggcatagattcaatttttttttatttgtgtgtgtatttaaaataacataatgatctaagtaccaaagcagtataaaagtgatggccatcattacagtagctagttgcagcagtagtgaatcagctattttagcctaacagaacattaaatatccaataaatttctcagtgaactcaattgaacttcaaggttacaatttgactcaccattttgtgttagtaaaagagatcactattcactagcctggtattgttggctagcagtgtgatagcttgcagccaaaatcttcctaatgtatgttaggtacctaggtattttactactacttccagtttgaactttgttagtaataatcatttgaaagtcctgtgactgagccagaaaccaaagttactaaaaaattaaataatgcaatagaccaaattagatgaggttatatatatatatatatatatatatatatatatagtttgagaatggagttaaaatttgaggctataatcaagagacacgtgcataatactaagatataacttacaaaaattcagctgatattctgtccttgttcacaccagcaggaagtggccagaccaccccatatggtccatatagtatttccctccgatgatatgaagaaaaggaagcatttggacaacctgcaactgtccaagagctagtagagcgtctacctttaacacacaacctgtcacagttcacacattggctcttttatcacaaagaaaggaggtcctatactacgaaagatctatgaccacgaatgtccaacattaaaatttccatttagcgtttcacttccagaatttatgctttatattacaatgcagaaataatgtataaagtttgtattaatagacaagaccctcccccggtacacaaatgaaagaaaaactcaacacaataatgacatagacaaaagtagagtatccaacaatattttgttttgccttatcttttccttcaccactcccttttctattgattagggagaactaaatgcttaataccacaaattgcagagtattacaattaatatgagggtgtatattagagattcttcttactttagttcatcaacctccactcttatatcactgatactgacacctggaacttccactgtgataacatatttgccttctgattctgcaacatccatccttggagaccacccaattcctgcaaaaaacaaaggtcacaaaaattatagagtacatagtctatgcactggtttgtgattggttttttcatgttcgttcaatcacaaatcatcttgtgtgaaaatttgtgatttgttaacttttacaatattacctgaaaaatcaaattaataatgatttcttatatgttgacaatataaaaaaaattacactaacaatgcatataaattaaactcaaaataatatacttcgatctgtttcttatagctattcaactattattacttcaaatgtctttccgagttcaaagttctaaccaccaatttcagaagagcacgttttcttttcagaatgtaactgatctcctctaatctgtctggttggcctagcaaatgtaggaggatcaagtgtactaaaatcacagccctgctcctgagccattggttggaccactgaatttgtgaaaactgattctgcccttgcaggtctagcaaaacatggtgctcttgcattagaaagacaatcagatgcagtagcaccatgatttgttttaggagcaataaaggaagttgagccaccctgaaagttagtgtatttgtattaaataagccagtgagaaatgaatcacttacccaaaaaaagtacatcgaacattgttaagtatttcaataataagaacacttgagtacctcttcaattgaagtctgcctcataaaataaccaagagaagcagaagcttggcgtgcaaaatacaccttattatatcatctccggagtacagagttcagactgccactgcagttctgatggcggtaggaaaattgatgaacaaaatgaattacaaacaaatattcaagaaaaaaaaaggatagtacgtacagattaatttattagacattgtaaaacaaaagctataaaatcaaattagtggtctactaaaaacatataataaaggtgtagcatatggaaattctgaattacggaaacacttttaaatatcaaaaagggacaaagatgaaggaaacacttaagtttaaaaactttgaagttgcttgtagcctacaaaaatgcattgatttgataagagtgttcaagttattattgcctaagccaatcataaaagaaaaggccaacttaaacaattaaatttccaatgctgaacatcaagatcaataaacacattagcataataaatagtgacatcaacagtacaagctaatacgtctcataatttaacgcaaatatgcaatatcaactgggttaaactatatatagaaaatcagacactgaataggtgatatttcacaatttattcaaagctagctgtatgagatgaaaggacatattttctcgtattcaaaaccaatgagcagtctagctactttcatcctttagccaataaaaaatgaagtgctagtccactttatacaatactcaaattatatgcagtttgattgtcctatgatgacaataaatgaagattcctattagatggttttttctgttcacatgaaaaggagaacaagggccagttagcaaaagatgagaaacataagttcaatttccccacttagctatatctaactcccaaataattcccatgtgtcgagaaaaacataactgaattcaaatgaattcctttattttccatcattatctagtgaaccatgaaccagccatgaacaaataagtaaaagaacataatatgttaccataggcagaacgttggtagttgaaatatcatcattgggtgcaaagtgagcagcaatcatgtgaattctgcgcttcactgactcactctccatttctaccaataaaaatgcttcacaaaaatttgagctaaaaagataatgcaggatggcaccagcatcagagtatcaagaatataagcagagggagtcactactgaatggaagatatttttaagaaaataacattagtggggcccattaaatctaaatatcttagtgaactgaagataatgtcagtcagatgccaccatagcacctggacccaaaatatcagtttgagactactgtagtctgtagtacttcttttttagaattttaggtacccttgattggaattatcttattattatcattattatttaatatttatttttaaaaccttacaaaaatttataattacctataaaaattaaaataatataatataaaatgaaaaaaaaatgtaatagaaaatgatttttttattgcgtgtcaatttaatactaagtacgctataaattaaatatcagtttattagttagagaaattatttttatcatttatatagtgtgtgtttaatttctttttgttttcattaaaaaattatggaccttaaatataattacatagtttactatgaaaattttaaaataaataacaataaataaaattagtaggttttttttactttaaaacaaaaatacaagcatactctttcttaattaatatcatgttttattctccataattattattttcctttattttattaaaaaccaatgaaaatatctcccacctggttgtctcattcgtgcagaaacaatttgtactatatatatggaaaattttacaaacaagataacctctctgtgcctgtccctggctacaggtttgaattcggaacagtttttctcttgagtttttttttggtgaaagttgttctctgaatgaatggccaaagtatagagtaactaagacaagaaataaagcagagtacaaagacatcgaagctgtgcaattctatatacctatatgcattaaacagaatatcacagaatacactgctgacatagagtaagtgcttatttgattgtcactacaaatctatctcacacgttacatgagttttaatataaaatctgtaactaaagataatcagtttaatggctaagcacgactttcaagatagttatagtaaaaatcaataaactcatcctaatgatttgtgataaaataacagtataaaagtactttaatttagatatacttgtttaacaattcaaaatcaattctatcaaaaattctaaaacaaccaaacactagctagtaatagtaaataataataataataataataataataataataataataatagaatagaaaaattcataaccatattttcatttccaaatatcaaagcctttatgttctagaggggtaaatactggaacgtggcttgttttatggtataaatatctgtgcttccaaattcaaataatcaaatttaaccactcgagacaaaactgtagaagcctaacatttgttgtgagcattaagaaggaagcaactgagaccattaagtcaaaatgcagaatagaagcaaactacttaaacagacactaaaaaatggaaacgatgattgcagctttgtgatcaatacaaattattaaaacctgcgatgttatgcttgtgacaaattgtttttgaagtgtaatattttaacctttagctagtgtcaagtgaaacagtttaacttaccaataaacgaaaagtgtgacactgatattgcagctttatcaaattagttaataaaaacttccacgcggatttagatttgagttgtgattctttagaaaagttttctagttttctaaggccacctatgtgaaagttttcttttcttgataatatttgttaatagatgctgcaagatttgcataatccccaatgtgtgtactctgaatcactcttgctccaatgcccctgctcctgctcaacaaaaagaaagaaaagcaaatgaatcaatattcttagctagcttgattctttgaggaagctccccgtggctactcatgctgattatcttcacagccaacataaggtgattcatggtgtacggtggtgatctatttttaatgttcctttgcgtaggaaattcatcatgtgactaatagcagaactttggctgctgcattgtttatgccaatttgtgtgcactaaaatatggatgtcataatatctgactcaatatatggtttgtgccaatttggtgtttcattgcaataggactttgggagcatttacacttggattgaatgataattatggaacgcaatgtcatcatctctaacgcactagatatgggtggtttttatatgctgtgggatgcaggggttctggtgtggaataattttttatcaattgaagtaattttgtcccaaaacttaaacactccttgtgcttggatattgttctgtctgttattaataaaaatgtagccttttcaaacaagggagcagagagttcaatcgcatttcaattaaacattatatggcaagcagagattaacttttgacacctgcaacttgtgtttattaaaaatgatttatgataaaataaaatggcgtcatttcatacaagtagttgactccacccaggctcccagttaaaataaaaacttgattgttgttgactaagcattcaaagaaacagaaaacaaagggcaagaataagaattcaactttactcgccacaaaactacaaaataaaactgtagtctaattgcacctgcaacatgatatttcagccttctcagccaccatcttttattgcacgtttggggcctaattatagtcagaaatataaatttccaagaattgtatccaatataagataatgatatgatttgtgctacaaagatgacacgctagagaaagaaacataagaacgaatactacaattcatgtaataaaacagaaccattgagtcattaattccatcaaactcactagggtactttacaaatgtcctcatattccacagctttaagtactctgccatcataggctcctttctcaatctgcaccttagcacaaaaattatctgtatccacccccaacagcttagcaattgatcctcgatatgcaccattgactatttttacacgccccccaacttgtggaatcacagtttcaagctctgcctgatcaactctgagaacatgcttgctttcaagcatttctatttccccaacatacttgtcaattaccttccggacaacgcccttttgcttgtagtaccccttctctgccaagactttgctcataatcttgacaacaattccctcatgcaaccaataatccttccgattaatttcttcctttttcttctcttcttccctcatcatttcatccaaagcagattttccacctccactttctttcctcttcaaattgtttctgggattcctttcattatatttctcttcatcaccctcatcaaacaccacccttgacgcctcatgtttttccttgaccacaggtttagctgatgatgacccaagagaaaatcctatcttgattccatcttccatattcagttccctcggaggctcaacctgtgaaggctgatcagcctcagaagtagtcggctgcatcatttgctcagccttttcaatctgtctcctgatctccttctcttgcttttcttcatctaccatatctgccttgattctcttattcttcatcctctccttgaaaagggtttctgaatctctatctatatatgtaatgaaccatcccttgggtgtttcctcaaccttacattttccagttcgacccaagtacttaacaaactcagtaagcgtagcccactgagtggagttcatatgaacgtggtgtctatcatttatgtattcgttataaactacagtggctgccacacggctgaatcggtgactgcgcttcatgtgctccagaaaggtggtctcaaactcttcggaatagccctcaactatccggtgtgggttttgtccaaaaatctgcatttgacgctggtgcccttcactcatgcaatggcatttaaacccattctcatctcggcactgcttctgacacatctggcaataccaccgaagcttctgcaatccttttgctttgattcggttggcaattgctttaggtgtgagaaactcattttttcccatcacgaatctggatgtcacatttcagatcaaacaaaacgttatcagtaatcctacacactgtttccttacagctgaaattacgttataaagcaaaaaagaacacaacaaaaacagcattagaacaaaagctaaaattcttaaagcattagaaaacaagaagcagagtactttggagcaagcatccacgttaaataactaatgaataaagttttgattagtatacaataaacaacttcactttttcgctcacacgttaattgaaatccttcaaggtcgaaggtcatcatcaattggcaaagattcccagaggaacccaatgattaaaacaactttactttgattctcaatacgatgcaacaataaatcaatggtttttcaagcattctctgttccaacatctttggctcggtatcctattctagtttgcttacatctcaatttcttgaaacacacttctatccttctcggtctttcaatcaaagcattaccaacgaagaatatcaatcatccaatcaatatacaaacaacgaggagagagatagatagatagatagatagagagagagagagagagagagagagagagagagagagagagagagagaacgaacctgaaattggcggcaactattccggtggtggcgttcgcggtggttcacggtggtaacggcaactacaattgcaggaaccctagatttgaagacggagagaaaataagaaagcgattgggatcggaaagggttttgtttttccgttgacgccgtgcttaattataaactagcttgggggaacgccatttataaaataaaataaaaatatattttaatcactcttgttgtaaaaaaagttgtattgattaattaactaaatagcattttaagtaatattgataacttaaaacaagtaatatttattgacttgaaaattataataaataatatgatatggcaatctgtaattggttggcaacacaaggaaaattttaattatattataagtgtattttaattaattaatttttttagaggatttaagtaattaattttaatatagtgttgattgatatagacgttagtcaatcaaataaaatcctatgacttttaaaatactaatcagacaaataaaccgttttcgattatatggcgatttataatttattgacaacataataaattttacatttttattggctccaattaaatatgcatacataaaattgtcataaaatatatataaatctatcacttaaaaaaatagtaatgttaggctcataatttaatttatttgcaatttaagtcttgcttttaatcctcatagttttggttaaaaatttcttaacccaggaattgccacgaatactgcaaatttaggggtatattttctgtgtggatatctagttagaattcaattatcttagggtttgtttgatttggaaaaaaaatgtggtattggatgggataattttttatgatttattactcgatacaaactacttaaaagaccaaaatatctattttttattctattttttctctcttctagatatattagaatgtcaacatcaccgatttttaataatccaccgagttcctggttaatcatcctattacatttgcgtctccacaatatatatagttatatacacactaagaaaaacaaagcgcaaataactgcagaaaataaaaaataaaatgatccagaaacattagcaaagtcataattatgtaatattaacccaaacgctgtctatgcaatccggcatttttcacctgaaaatctacacagccgacttatatgtctaatgctcaggttttagtagaataactccctccaatacataaagttgttcttctaacattacacattctcatcaagacatcagaaaaacaatccctaagaagagagtgattcaagacaatcagttcctaagtacaagctggatattgaattgcgtgcaagaagctcggagtccatatcttcagattaacagtaagaaacctgccacaataatttgaagttctctattactatatgcaagcagaattcagtcagtctcaatcaagagcaaccacgataattttcaaataatcagtgaatgtgcttaaaagaatgcagtccaacaatgacaaaggtaaaagatttcacaagtgagacagaatacacaggaaatgatggagaaaagccatataaatcccttgttaagaatcttacataattctactatgttaagtttaatatggaatgcaaaaaattgatgtttcgaagctaaataatattagagcagttaaaattcaagtcatagaatgagacaagaatgggacgcaaatacagaccacaatgagacaataaccacaaaaaacaataggaaaatatatatttcatagatcaaatagaagaccacattatcatcaccatatattttagacaatagaccactaacatctaaaatgctgggtacagaagcaatgtcctcaaccatgctaaatcattagttaaaataaaatgaatatataaattggacagtaattaagatgtcaacagtaatggatacattgattcagtgaaaagtaatttgaacatgatagaaatggttgtcaaactcacaagtcaagaaaaccagttgagttacattgtttttttaagaagaatttattagacgtgcataaattcactagttcatgagggaatctgacagtccacaagcttgagtcatgtaatttctcgccaaaaggcagtctagtgagtagcattgggtagacatgtataaattcacaagtccaagagcctgaaaatctactgtcctgtgacatctatttttcccaaaacacagtattttgaaacatacagttcacggctcatcaattaccatgatgcaaatcaagcaacactgttgctactgaaactaggatgaacactcttgaaaataggactgatctagggtggagacatggggcatatattcagggcaatggcaaaaaaagtcggaactatgaatgtttattatggtgatgctattaaattatttttggatactatgaatctatgataggtttttttatgaagtaaactcttgtcagttcaaatattaagtcaatggatgttccaagactataaaatagactcttatatatgactataacatgatttttacatagactcttgagtttgccaacattaagaataggcagttctctaaagaacatagttgtcaatcccaaatattggctgagaggcagaccctgaaaatactatagctgaactgcaggatggcttttattctaaccaattagaataaaaagattaaaggataaactttgaggagagttagaatacaagataatacctgttttagagggaatgaaaaacagaacatatgaacagaacaaagcaaggcagcaaaggtcacatttcgctggaaacagtaacaggtttgcactaaatggccgcataattctcagggatgatcataaactatggagagcagaggctgcagatgttggggatggccaactgtcacaactggacagaaaatgctgagaaatactggatatgttcccagaaaaggatgggtgtttggcagcgccaaggccgccatggcggaatggcatggcggttctttgtttttttgccaaccaccatagacaacaatgtgaagggaagcccactaactatggcagcaccatagggtacaatggcatgtttatgtagcagaaatttggatttcagccatccacaattgataacactgactgcagagctattcaatttttgtaaaatgctccagccacaacactttgcgagcacgggatagcaacactatttggcactattgacaactatgctaaagcatgctcctttacaaaggtaaagggaacagaaagaattacacatttgccttaccaccatttggatcagttagcatttaatttccttggttagagtttgcaaatagcttatactagtttgcagggaagttatctttccttgatgatttaccaacaggaataacaataaaacaccaagaaagccagcttggtacttatctggccacaaataaagatgatggaaaggcaaaagggtgggaacgtatgtgtatacacacacatataatatacatatatatcttctcttaaaacagtatataaaaaggtaaattccaaaattgtttatagcaaacagcatactataattttactctgcaactcaaaagtcacaatcatgtcgaattatcgatagctatcctaatgagtctagaaacttgactaaaaggtattgatgttaaattttgcttcatgcccaaacataaatttgagttggtattattaatagccacccacccggctccaacacccttacaaataaaaacaaaggagagatttatgataacaaaattagtttttccttgcaagatgcatgatctcatcttaatcctaatttaccatttaattttccttctagacatcactatctctcacacaaaaaggaagagtgcaagatacacataaaacatagaatgtgtgtctggatgctcagtggatggtaaacaaattgattccgcctcttgtcaaccatggttttagaaaagatacaaatttggtcattgtcagactataggtgataaaaaataaatttgaaatttaagtcgcaaagtcaaagttaatttgagatgtccatggccacaattgtggcagcacttgtccacaaattccaacaatatcaaggaatgcgatggcagcagcaatttaaaacattgatgttgaaaaatttaaactaaattttgcatcaaactagctattatagtaaaatcaatcaaacataaataacttaaaaatcaattttacaaacgcacactcaaacactcacacacatacactcactgactcactcaattctgcaaacacacactcaaacacataaacagaggattgaacaaaacaataaatacaaacctaccaatcatctctcccattactgttgctgttgatttggagggtttggcggagggggcatgccagggcgaggaggaccaaacaccggaacaccgctgccaggtggcggtggcatgccagggcgaggtggtggtggagccggcattccggggcgagggggagccggaggtcctctcaccatctgtccaggagggggaggccccatgggtctctgtccatactgcggtggaacttggaactgtggcggagggccaccaggtctctgcggtgcaaattgcccaggcggcatcggcggtggcggacccctcgccatgggaggaggagcgaattgccccggcatctgccccggaggcctcatcacaggcggtccaccgccgggatacgacaccggaggtgcgttgagctgcggcgggcgcgagatctgcggctgcatcatgccaggggcggggccgccgacaccgcggacagggccggcaaggcctggctgagcctggacgacgggagcgggtgggatacctcttccggcggcgcggccaataccagggccggcgagagcggcggcgccgactgccttggagcgggactcttccggcggaggagggccctcgacggtcatggagatgacctcctcgccgcggaggaggacgaggccgagcgtacggcggtcctcgcggtcgccgccttcggctggcttcttgcccttgggcggaggaagcttgcggaactcctcgcaatcgccgaggacgaggttcatgtggcggtcgaaggccatgaattttcctacgagctggcgaccgtcctgaatggtgacacgcatacggtagttgatgtactgaagcatcttggaactcttcgacatcgacattttgtaaaaatggaaattgtcttctgccgcagcttcttcagtgagagtgttttagggtttaagaaaaattgggaccttagaggagggaaaatattgttcactccatacactcgtttagattaagccaaccaactctgttttatatagtgcaagatccaattaagtcgggccaaggcccagagtccaaaagtgattttttttttttttatatataaaaaacaaaggagtcttttcatttacactagcataaaaattatgattagataagaaagatattaattagaggataattgtgattaaataaagaaaattatttttttacttgtttatatttcttttgttgataaattatattttaacaaattgaataccagtgtagggagttttcctttatagattaaatttgaatgaagataaatagagtatgcatggtctttttatattttatttttctcatccatttgtgattattttatattttttttcttttttgggaagttattcattataattgtttttcagaaccctttcaaatataactttttatgtgcatgtttaggtctccggtaggagattccaaacctaggtttgtaaaaataattcccctattactattggactcaaacttacgtttgaggggcttccaccagtttcccaaacatgctttttatcttcattatttatgaatatgctattagttggagagcaatgctttaacttattcttgttttgtctaccaaaaaagtgaagtatatatgtcattaacaaaaggagttgaagaagatacgttaatcactggaatttgattttcgatttggacattattgaatcataattaaaaatattattttatcctaatatggtctaagctgggaggaggagagttagatgagtattaaataagaagtctcgaatacctgtttgtcacacaaaaaatgtatgaaattataagatcttattcatgatctgggtttgaatatgtaaatacatattttttattgagatattcaaagtgcattgactttagctaaaaaatcaacctatgatgctgagtgaatttcgtgagtgtatgtaatttgttttccataaagaaataggcacaacagtcaatccaattgatatgttgactaagactttgtttactaatcaaaagttcaagcatgtcttggatttggtaaatgatcgtataattcaagacccttcagggttagttgagaggatagtatttttggttagtgacgatttgatgtgtttgtatataacataagactatttatatgttatttgtgcaaaattatatagttttatattttgtctccctttgagtgtaggttacgttgatcgaaccaacataaaatcctcatctctctctctctctctctctctctctctctctctctctctctctctctctctctctctcctcctttattgttgtttatgaattagattgtctaagtttcatatgagtttaataacattgagtatatttacaattacaatcaacttaactcatcaaaatgaaggtaatgacaaaatgaatgatttgtaataaccataagaaaaacataagataagatggggtttgatttgagtgttttttgtttcaatttttaaagaaaataaaaaataagagtgaaaatacatttgtttaaaatttaaaaaatattttatctgaaaatatttttaaaaatatatctaaaactgaaaacaaccaatcaacattttaagccttttataaataagtaaaaacactgtaacaccttagaatattttattcttgatacatgttttataatttttaaaaaaaattaaaaaaatagaaaataaactttcaaacaaaacaccacctaatttagcatctaattttgatcgacactacggtacaaaagctaatgctagatgaaaactttgatcaaaaattacaaaataaagttaatgacaaaataaatttcatttctattttttttaattacactttgcatttctaagttttaaattttagtttcttaatgtattgacacgacaaaataaaatgggtggtaaaataagttaattatatcatatcggttaagtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggatacattaaatgcatattaatactgaacaaaaaatcatgctatgcctttttatttaatttctatatcttattatatttcatcctatttttgctcatttttgttaaaataacgatgcatagatattttatgttatttgataagagagaaaaaataggagaattaattttagatataatgataatatgaaatatgatatatacaaagaaagacttcattattattttagtctctcaacttggggattaaaatattttagtcttctaaatttctttttaatctttcaattttgaaaactgcaatttttaatccttttcatgattatgataattttaaaatgcaaactttggtagcttaaaattaaaaatcaaattatggaacctaaaaatcatcacaaattatcgatctattattctcagcctggcaagagactaaaacgaaatttaaattaaaaaaataaaaccctaaattagggagttaaaactgtaattatgcgtaaaataaataaaggaaaataagaagcatcaaactatataattaatgaacatatctgcatattactttttctaagaaagtcgacatatcacatatttcaattaagaagtaaatatttttaaatatgctgtaagtattgaatttactctttcaccattttgatggggagcagcaaaacctgtatctgcgattctccctctaccacttcaccaagcccactgtttttatcatctaatttcaggttttattggattaaattttttgaaatattattttagtataaaaaataataagaaatgatgacgtttggattaaaaaaataaaattaatataattttttaatagttatattaattttagttttatattctcttatattagcatcttcttattttcacttttgaatttaaaagtagatttaaaattatactttaatttttttattttcgtagaaatattaaaattattttatgataaatttaatgatatatttaaatgagataaataataaaaatatactataagagagtagtgagggtgaaaattgataagagaattactaagttatgtggatgatgaaattaaagacataattacaaaaatattacgttaatagtatggtaatttaattagaaaacaaaggaaaaaatgcaaaacataagaatataattgacattttttttattccaaaataataggagagacatatgatacatatatcttgaaaaatattaaagagaaaaaaaaatgtatgtgatgagaaaaaagaaaatatgttaatcaatagaaaaagaaagaaaaaaaatctaacaaaattttaagaatttagatgaaattatttaataaatattttatattaaaaagtatgataaaattcaccaaatcttaaaaaataatctattaaaattttgatagatattatatactaaaaattatgataatatttgttaaaattttaaaaaataatctatcaaaattttatgaattttttaataattttttatataaattataaaaaattataattaaataacaccatttttttttaatcttaactatcttaattgaatactaaaaagtttatttatagtatttaaaaatatttaaaaaacctgattcaatatatcccttcgtctcagcatctctcaaaacagattcctagtcatcgatccttaaaaagtttaccatatcttttctatttttatgcttgatcttttctaaattaaggtaacaacctagtaagtttatcggattctgccgcagtaacttcgatttgcgctaaactaaacatctgaggatctcagaggggcatcacattcacattgagccaaatcatcacagcgacattctcaaatcacataaaaaaaatagtgctcagtccgtgagagttcgtatcacggctctgacactgacacattcgcacgggatccctactttcttctctcgtttttttattctcccatcaattatttagcaacccattaaggttctcgtcagaaagtttacatttttattgttagtttttaaatatatttttcatcgtttcatcagtgtgatcacacaccatgatttgcaccgtgaaacaacccgccatatccatcagaggttctgatcttttcctgcgtaaaaagtgttcagcttcaaccccagttcagtcatgttcccttgtttcaccttcttcaagggaaaaaaactctctgagatcattggtgtcagtgcaaaagccactgcacctttctcgtgttggttttggagatttcgttgggtctctggtgaggcgtgagcgtgctgatttcgtgacatgtgaggcttatgaggctgatagatcagaggttggaggggctggggctccatcagaggctgctaagaaggtgaagattgggatatactttgcaacatggtgggcactgaatgtggtgttcaacatttataacaagaaggtgctgaatgcattcccatacccttggcttacctcaactctctcccttgcatgtggctctctcataatgttgttctgttgggccaccaagatagttgagcctcctaagactgatcttcagttctggaagaatttgttccctgtaagtgactcacttttgtttgtttcctcaggataaatttgatgggagaaaatgaaagcatgcttttttgtttgttcatttgttataatttacgtgtacttgttctggggaaaacatttttttttaagaattattttgtcccatgttttgatatatgtgtgtgtgtgtggtttgacttcagggaagcttgacgatttcatgaaaaagagaaagagaaaatttaattcatttaaactatgttgatgaatgggaggaggtttacaagagagatttttttttttaatgatggaaatttaagttttggaaaggttttagaaaattgtttgtgactgtgattttggccgcaatgtcaaggcttttgtggcctttgtggctgcaattcgccgcaatatcaaagatcctgatgaaacctagaccgcgtctgtgaccgcaatttaattaagaacttgaatcgttttggcttttccccctatttatttatttgtttattaacatcttgatatggattgggaccttagtgtttgctgttttcccccgcaggttgctgttttacatacaataggacatgtagcggcaactgttagcatgtcaaaagttgccgtatcattcacccatattattaagagtgctgagcctgctttcagtgtaatggtttccagactacttggcgaggaattcccagcgccagtctacctgtctttgattccaatcatcggtggatgtgctcttgcagctgtgactgagctcaatttcaatatgattggtaaagaagttgcttttctatcaaaaaaatgatctgttatctaattttgttctattttgtatattgttgttgagcatagtataaaagttggatatgagaagataatctgacttgaactaaaaaatttgacccgagagaagaaaatttgatggcaagttattgattaaggcaatgtcataatccctttccccttcctccacaagcaaagtgattattactggaattctatttatatatttatttaattattatgtgttcatgcttgtgttgagccaccaacggaatggatgatttactattatataagattcttgggtgtttatgccattagcagaggttatgatggaatgtacataacttttcatcttttctgcataggagtccttcacaccctcctgattttgatttcattactgttttattatatttttcaggttttatgggggctatgatatcgaatttggcatttgtactccgtaatatctattcgaaaaagggcatgaagggaaaggatattagtggaatgaattactatggttgtttatctatgttgtcccttgtaattctcacaccatttgcgattgctgtggagggaccacagatgtgggcagctggatggcaaacagcactctctcaaattggaccccaaataatatggtaattacaaaatgtctactctatctgatgttatcaatgctatgtttctgtaaaggtgatatcttgaaattatcataaattcataatatttttttcctacaattattatagacatcttgtgtccttttcagaaattcaaatttattggatgttgggcaaattattagttcatttgtttttgtaatgtgtacactatctcagagcaggagaaggtaaggtggaggtggttggattgtttatggagttgctatgtagttattagaaattagagcaaatctttttcgtataactagtcatagacgatcaacattaaaagctgcttaaaagtagcatgactaaaaagtccatgatttttgttttaaatcttaattgttcttggttatttttagaaatgcaaacatttcattataaaaatttgattttaaattttcagttcaaattgtttatttaattgtaaatctcacgtgattttttcctttttaatcaaagatcaagtgagattggaaattaaatatgcaattaacagttaatttcaatctaacagttgtaatccaatgttttcatttctcacaaaaattaagagttctcaccttcacatacacatatgctgctgaccgtgaagctggtgtgaaacctgatttatgtgtttggattttcaaacaggaaattgacctgagttcttttgtttttgattttgagttatctaatattcttgtcctttcacttgtggttctgaaaatcttctgcattgttttgtcttatgattaaacatatggctgctacttgtgcacaacaggtgggtggcagctcagagcatattttatcatctgtacaatcaagtgtcatacatgtctctggatgagatctctcccttgacatttagcattggaaacaccatgaaacgtatatctgttatagtttcttcaatcattatcttccacacaccagttcagcctattaatgctctaggagctgctattgccatcttcggaaccttcttgtattcacaggtattatctagatgagaattttctatagtgatattttattgttaattattgcgccccttggccatatcatgcactaaatgaaccatatacatgctcatactcttacttcttattggttgaagccttggaggatccttttcaaaggttgtattaggttggttttggaggctagcttcaggggtgacatagattgtgttgttagacattgggtgattaggtggaggaacctacactgtcaaatactagtgtgcaaactgtcttgggattatacttcaaaagatatttggtggaacaatttgattttgtatgtacacaagaaggaaaaatttgagatttatagtcataggttagaattgagtgatggagctattctaaattaggtgatctgatttttatttagtagcttcactttgaattgccacctatgacctaaactactattggtttgaatccaccatactgtttattccttttctaaatctattttattacgaattagcatatcaaagcttcaaaagttgactgcaccaatccatttgttcacatgttaagtatctttttacatatagtttgttgtggagggccttgaaatatcaagaaaaagattggtggtaagaaagtaagaaacagagtactgactatgtggattgcttataatgtggttttcttttgaaaacaacaattttagttgcaggtatatatacacaatctctcattctacttattttttgcaggcaaatcagtagggttgaggagttcagaattatccccgaacttctttacatgtggtcatacaaggtcaccgataaggaagttagttttggaatgtggtagctggattatggtaaagactggatgatccggctgtctgcctaattgtacataataattaataatgatgacaccgctgtggaacattattattagagattattagttttttgcccccctctatttctgaattatcattaagcttgaggaataaacgtctgtatttgtttggtctgaggataatttctcaagacatggcatattataataagnnnnnnnnnngaccaaacataattttattgaacgtcttccatcccaaaataagtgttatatttaaaaataaatattatcctaaaatcagtggtatgttaagtttccaatttaatatcaattaattttttcaataatactcctaataattttaatgtagcttttcaatataacattaataataagtttagctttataaaatgaattttgttattctaagaacactaattaagaaatcaaaaataggaaaatttatattgaaaatcatgtggagtgcatttaaatatcataggaaaacacttttttcactgtttccaataatatatattatcctcttttactttcttaatcctaggatactcattaacattttttttttaaaattactactcttttttttatctatttattaactttcttggtctgtgtaaaaataaaaaaacagacggagatttattttgaaatgaagaaagtaatttttatttagatgagaatttttacacaaacaattaatatttaaaaattagactcttaaaataattaatacatgtacaactaattaattaatcttaaaatattaactatcctacactaattcacnnnnnnnnnnttgtttctctttcttcttttatttgccctcacattctctctttcttcaattaatacacacaaaaaatttatataaaaactgatcatttactttatgcaacatataaaaactgtaaacgtaggttcaattcattaaaaaaaattgaaatacaaacgacaaatgtaaagtaattgattgcaaatatttcttaaaatttattgctaaccatggaaaccattgtgggacttgaggaaattaattaatggatatatacaatctacaaaaaaaaaaaaaaaaaaaaannnnnnnnnntcaagtgtcatacatgtctctggatgagatctctcccttgacatttagcattggaaacaccatgaaacgtatatctgttatagtttcttcaatcattatcttccacacaccagttcagcctattaatgctctaggagctgctattgccatcttcggaaccttcttgtattcacaggtattatctagatgagaattttctatagtgatattttattgttaattattgcgccccttggccatatcatgcactaaatgaaccatatacatgctcatactcttacttcttattggttgaagccttggaggatccttttcaaaggttgtattaggttggttttggaggctagcttcaggggtgacatagattgtgttgttagacattgggtgattaggtggaggaacctacactgtcaaatactagtgtgcaaactgtcttgggattatacttcaaaagatatttggtggaacaatttgattttgtatgtacacaagaaggaaaaatttgagatttatagtcataggttagaattgagtgatggagctattctaaattaggtgatctgatttttatttagtagcttcactttgaattgccacctatgacctaaactactattggtttgaatccaccatactgtttattccttttctaaatctattttattacgaattagcatatcaaagcttcaaaagttgactgcaccaatccatttgttcacatgttaagtatctttttacatatagtttgttgtggagggccttgaaatatcaagaaaaagattggtggtaagaaagtaagaaacagagtactgactatgtggattgcttataatgtggttttcttttgaaaacaacaattttagttgcaggtatatatacacaatctctcattctacttattttttgcaggcaaatcagtagggttgaggagttcagaattatccccgaacttctttacatgtggtcatacaaggtcaccgataaggaagttagttttggaatgtggtagctggattatggtaaagactggatgatccggctgtctgcctaattgtacataataattaataatgatgacaccgctgtggaacattattattagagattattagttttttgcccccctctatttctgaattatcattaagcttgaggaataaacgtctgtatttgtttggtctgaggataatttctcaagacatggcatattataataaggttttcttaataataatcaaagtacggtgatcttgtttataatggtcgttatgattcccattaatgcttgctaacactagtgaagatgctggctggagctttaatttatatttttgggtcattcttgctttaaattagcctttgattagcagatggaggcccagttaactgcccctatcgtgtccgtgattatacttctattctattttttttttaccgacaaatgttattcgttagtttttgttagtgagcgaattcgaatttataacatcttttttcctttttttctttaatcatcaaattaaccttataattcttaaaactgccctacttaattcatgcacgtgtcatttgttagagagatctctctaggccatctaataataattggatttcggtcaattttttgagaattaacgaagaaacataatctaatgtatttataatatttttaatggcttgaagattgttcagctcacctcacaccatcagacaatttatgagaatcattactttggggtgggtgattcttgtatgtagctttggtttttgctgtgtctcaatttatgagaatataaagttgtatcacgagcttatgaaattttgagtgagaaatatgccactgacaaatagattagtaatatgagactaagctccaagatgggtcgtgatcagaatttggggatggtagattttgtatacgtactactagaaggtgaagtaatgggaagagcatatatactaacagaaacacttttagtctagctcacaatagaagtgaagtatatcattttttttgtgttgatacgaagtatctatttcatcttcaagtgactatcttgttttaatttttagatgtttagttttatagaaaaaagttatttgaaaaataaacctcattattttatctcatttaaaaaatgaacttcatttcctaaactaccttttatgcttactgatgaaatacttcaattttaggagatcttgtttcaaatgataatgctttctctattttgaaagtcatatgattcatatcgcaataatataaggttgttaaaaataaaatctaaattaattaaagaatattttagaaagaataccattaaatagagtgaaattaattaagattaatttgtttatattttggatcaccacacttaagtttagatttacttatcgttgaatctagatagtagcataaaagtttgagcgtccatgtctatatggtcactacaactaacaagttccatttgaaagaatcactcttatgtatgctgtgaacctgataaatgtaaacccaaaaatgagatggcatgaggtggaaggaagagacagaaataaagaaaaaagagagagataaagtgctagatgtgatgaaaaatagagataaaactaaaatgaaaaagagatgtatgaaaaagaaagtgtgtaaattgaatattttcctatatgctatttctaggcatgggtgtttcattttgtcaaatcacttgtatttactacatgtttgataggaaaatacataagatacactcatttaagccttgagtctttgaagctatatatattcatgtagttttattgagactaaagtgtttaattctcgtgcactcaaacaagtttctttgggttggatggaagtgagactcagtgctattaaggctttgctttccaattgtaacatgctggagagtttgaattttaaaaggtgttggaattcagacaagtttgacctaggtaaagaaaaacacatggatctgacaaagctcgtcctggactaataatgcggctttgattttgattatttcaaagtcaactaatgaaacaaatctcaaaattttcaagtattgcgggtggatgaactttgacctcatagaaattgattcactcgcaatggaagagatagattttgatttctctgtagaatattcatttgaaggatttcgttatcctaactacagtttggtggaagatgtttgtactgctaaagttttgactgtatgtagttttgtgcttcagatataaattcttcatcaccttttctctccctcataataaatttgtcaattgttatcatatattagtactagttttataattatatataagtgtatagttacccttatagtccatgataactttcactcttttgacatgctccacttctgtttggatgaactgaaatatggattaattacaatatcttatctaaattgttttaattaacgtattgtgtgtgatattttaaggtgattcctactggtcccgaacgtatggaacctgacatggatgtacatgtgatcatgaagatggccttgcaacatataatgagtttattggaatctcattcttcctcaaaagttgtcctatgttagagcgtctcaccactgaactaggttcaataaatgacctgtttgtgagtatcaactacgtaaattgaatttgtttttcctatatacatatgtgtttgtgttaaattttgaatttgcttttaacacatctatatatgttgtggttattttctattaataaaaaaggagtctaatttttattagaatgtggattttggtgtgtggataacatggtgggtggccagttaatggatttaggataggttctgataccatattagaatgtggattttgacttaactcaaccccaaaagctagctcatagggtgaggattgttctccacttatatactctgacttgacactatctctagccgatgtgggacttgagttattttcaataattttttttgctctatattgtagaattatgaaccaccgttttattttaacagcacacaattctggattgaatatttggatgtttgtgaatgattgagttcaagttgagaagtggtggaaattaatggctttagaggaactctaaatgaacacctcttgctcaagtatttgatctttcgtggatttgtcttgaaaaagagtagcatataaacatgttgaaggatgattccggtaagactgtggagtctgattgccgtcaaatggcagaacttctgttgacatgtccaagggcttcaagaaacttagagatatcaatcttttaatagatagttttgaagaaagtgttgaatcaatatataatgtcctgaaaaagtactctatctttaatattattttatagaaccttcaactttttattcacaaaaaaacaacttaccatgttatatgtttaagttctaaatcctggtctttgttgttatgcatttttagtttgcaaacgttacttattaatacaagacatttgtctatattatataaacgcgttttatttagatttcacagatttcattagatgcatatatatatgttatttgttatttaaaaaattcactttacaataatagcttttaattgtgtttcagcttaagattttccattcttttaaggctaaaatttagtatttatgtgcattctaatatcaatatcaagcgtggatattgacagatacaatctaaaagctatgcagatttatgttatgtagtattttatcaaaaggacaaagaatcatgaagacagaatccaagtttgttgcttttatggcaagagaaataataattttatttttttctctttttattgagatagtgtaatctaaaacaaaattgatatactaacttggtagaatttgaaaagtgtttttaacttggggtaagtcagggagcaagtggtacttctcatctatggcttactttttttaaatttaaattatagtaaaaactttataattagtatgctactaattataatatatatatcaagtcttagacatttttaggattaattttatttttgatacattagatatatcatgatttagtgattttggactctgaaggcacagttgcgtgaattgaatcttttaaatgtcacaattaattatgcatttttagtatttttttcatacttttttaaatatttaataaatttttcttatgtgacactaaataagaacatgttgatgaagtgacatttaacatgttatttaaaaaacaaattgacatgtcttaattatatttctagtattttatgtatcataattataagtgattaaaagtgtaattatgtcatatcagtcatatagaagttattgatttaatttacattccaaaatatttcttaagattttaatttgtgttaagtttcaaaattctaaattaaaatgatatatatgttaaattatttttcaaatgatattaaattcttaaatttaatttaaataaattatttttaccatataaaaatagtattattaaaaaataatatagaagtttttaaatattttatcttttataactaatccagattttttaattaatattatatannnnnnnnnnnnnnnnnnnnnnnnnntcaagtgtcatacatgtctctggatgagatctctcccttgacatttagcattggaaacaccatgaaacgtatatctgttatagtttcttcaatcattatcttccacacaccagttcagcctattaatgctctaggagctgctattgccatcttcggaaccttcttgtattcacaggtattatctagatgagaattttctatagtgatattttattgttaattattgcgccccttggccatatcatgcactaaatgaaccatatacatgctcatactcttacttcttattggttgaagccttggaggatccttttcaaaggttgtattaggttggttttggaggctagcttcaggggtgacatagattgtgttgttagacattgggtgattaggtggaggaacctacactgtcaaatactagtgtgcaaactgtcttgggattatacttcaaaagatatttggtggaacaatttgattttgtatgtacacaagaaggaaaaatttgagatttatagtcataggttagaattgagtgatggagctattctaaattaggtgatctgatttttatttagtagcttcactttgaattgccacctatgacctaaactactattggtttgaatccaccatactgtttattccttttctaaatctattttattacgaattagcatatcaaagcttcaaaagttgactgcaccaatccatttgttcacatgttaagtatctttttacatatagtttgttgtggagggccttgaaatatcaagaaaaagattggtggtaagaaagtaagaaacagagtactgactatgtggattgcttataatgtggttttcttttgaaaacaacaattttagttgcaggtatatatacacaatctctcattctacttattttttgcaggcaaatcagtagggttgaggagttcagaattatccccgaacttctttacatgtggtcatacaaggtcaccgataaggaagttagttttggaatgtggtagctggattatggtaaagactggatgatccggctgtctgcctaattgtacataataattaataatgatgacaccgctgtggaacattattattagagattattagttttttgcccccctctatttctgaattatcattaagcttgaggaataaacgtctgtatttgtttggtctgaggataatttctcaagacatggcatattataataagnnnnnnnnnnnnnnnnnnnnnnnnnnnnnnnnnnnnnnnnnnnnnnnaagaaaacaatcccattaaaattttatgcattttcaccaaaggttggcttcattctaaatccaacagtaatatattatagtaattaatatatatatatatatatatatatttatgttttcctaaaaaaaattctaataacggccggcaacgtatacatggaatttacagaaaagaaaaaaaaaaatacaaaaatccatatagaagtatgcaacattgttttctcactgaagcaacgtctgttgcatatataaggtagcactcatggccatttcacacacacatttcaatcccattggaatatttgaagaaaaattcagtaccctaatagtcttctccacatctttattatcaatcaccatatcatatagctagaaccatggcaatgagcatctattcgttgccaatggaattgcttataactatcgtttcacttcttcccttcaaggaagctgtgagaacttctatcctctcgaagaaatggttggagttgaacgtttgcaagttcacaaaaaacatagagtttgatgaactcttttttgttaaacctcatcaacctaatgaaacaagagaaatccaaagaaggacttttcttgacttcattaatttgtggattgaaaatcacaaaggaactttggtggagaagttctcttttaggttatcaaatcctagaaatggtggtgagatcattgatcaatgcgctgcttttgccacagagcgtggggtgaaggagttggaacttgactttgctgatccgaactggaatgaaaattattatggtaattatgacgaggcgcagtttcaattgccagcactagtttaccagcttggtagccttgagtctttgaagctatattcttgtagttttgttgagactgaagtgcttaactttcatgcactcaaagaagtttctttgggttggatggaagtgagactcagtgctatcaaagctttgctttccaattgtaacatgctggtgagtttgagttttaaaagttgttgaaactcagacaagtttgacctaggcgacgaaaaacataagggtcttagaaagcttgtcctggacaagtgccgctttgaatttgatgttttcaaagtgaacgcaccagatctaaaaaatttccagtactgtgggttaatgaactttttcatcacggaaattcattcgccctcaatggaagaggcaaatattgatttctctcaagaatatggcttcgaaggatttggtcatcctctttataatctggtggaaaatctatctattgttagagttttgactgtatgcagttttgttcttcaggtatacattcttcatcaccttttctctcttgaaattaatttcttaattgtacgttatcatatattattatatattctacttttataattataactttcagagttccactcttttgatcaatttgttccatttctttttcactgaattgaaatatctaattacaaaatgatttgttgatggtttcaattaacgttttttgtgtgtgatgcgataagattattcctaccggacccgaactgctaggttttcaaagtgacatgcttgtgcaacatttgatcttgaagacggctttggacaagaacgagtttttgggaatcacattcttcctcaacagttgcccgatgttagagtgtctcacgattgatctatgttccgaaaaagatttgtttgtgagtatcaatcacatgcattgaatttgtttatcctttatatatattaggtttttgaatttgctttgcctatatgtgtggttttttcatttgaaaaaaagaaagctgctaattttttgttacatataatgtacttaggattatgaaacaccgtttctgtttaaccgcacgcgattctggagggacaacgtgggagtttatgcaagcttgagttcaagtctggaagtggtggagattaatgggttcagtggaactgagaatgaactttttgtgctcatgtatttcatcggtaatggagatatgttgaaaagggttagtataaacatgttgaaagatgattctggtaggaccatggaacctcaattccgtaaagatgcagaatttttgttgacagttccaagggcttcaagaaacttagagatatcaatctgttaataaattagtaatagtattttaatttgagagtattgtgaatgtgtgactgggtgctacattcaatgttagcgtataaactctacaacaaagtcgatatgatgttataacatctctatgctaagagtttatttcactgatttcatcaagctgtgtattcatttttagatttcgtaagtttaattacatgagggtattgaatttggtggttacttaaaaatatgcaatttacatcagctttctatgacatagtacttgttttcttttcttaggaattgtgtattgggttcctattgaacacgggaggaaggctaactaaatgttcctttaattaatatatattactttgcgcatttctttctctttttaaagatgaaaataaatataaaataaataaataaaatgaagttcttaaaaatatataatatattaatattttttacatactgtaaaaaaatataaataaaaatgatatttaaaatttcttttaaatgacatgatgttgcatttgatgaaaataaatatctttctaaaaaattaaataaataaaatttgaattttttaacaagtcaaatttatatgtattagataaatatcaaaattttaaaatgtaaactaagaatattatatgaaactacttttagttgacatgatattattgctttgttttttatgtaaaaatatattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattatagtatttaagatttgaaaaaaaaaagattgaatataatcatatataacttattatttaatttctatccttaattattaatttaaaataaaattgtatcataaataaaatattactatctaatattaaaattatatataaaaataatattaatgtcaataacttaacttttcattaaatgaattcaggaacattaaatttagttaaatttaactactattataaatttaagtgattgatataacgaccaaaaaaaataaggaaaatttatatatatatatatatatatatatttatattagcttttacaatacattcaacataattgcatcactataaatcacattcaaaaatattacatcacttcaaaatcaagacaaatataaacaacacgttacacattcatctaggttttactctttattcagttattctcactcgtaatactataatttcttagaaatattgaacaattataaaagaaaatgtgttagagagtaacattaaatgaataaaaaaatatatcataaaaaagttatatggaaatagaatttctcctttatcagggcatgtaaattaggtatctaggtggtgaatggtgataggtcccagccaatatatatgaaaaagttgacttgttttctttctttctcattctattttttattctcctttgtcctgctatatacatacgaatcagtgtgtaaagaacaatttagaagtcaattatgggttctccaactctcaaatttcgttccactgtccatggtaagttaaagagcttggccatgataaacttgaaaattttgttgacatttatgttgtgggttgcacttgaaaagaaaagggttgccttcatcacccttgcatatccccttgcctgtatttatgtgacgacgcaccaagttaaaatttgaaaaaccaaggattgtgataaaaagttgtagtattagctttatttaaagtgaaagtagtgaactgtgaacacatcaatgatccgactttaatcaacatgtaagccccaaagttaatgttaaacgcggaaacatggaactttcataaatgacacatgctgaggttccaaatacgactcctatttattactagaagaattattctttgttcccgagtcaataggtgaaaatgaccaaggcaagtaaagcagcccccatccatatatgtaatatgattaataggaattaagttaccaaaacctaatttgcagcagtaattattattatttcattcatttacctgtgttacaattgtccattgcacatctgggggaagtctaacaaaatcgtcaaacttggttcctattagaattggaattgcagtctgcaaattgaacaaattaaatgtcatcagaaatttcataaaaaatacgtcaaaatcttcaaaatttggatattatcagcctaaaacagaatatttagttatattaacaagccattttgatatattgaacaaatagtataccccggcaagtcaataatcagagttcatttctccgtccagtcttaatgaaaaaaattaatgtcactttcctgtggatactcaatccatttgcactgctacttcaaaatttctctcgtgttttacaaaaagagtttccatgccaaaagcctttggaaactacactttaacttaaacagtggcagacactttctgaaataaaatcaattcatgtaatagtactatatataagccctgcaaaattattttttacggtacctgattccactgtcttgcttcattataccatctaacaacactgcacgaacataacaaagtacaaaaaacgcaaatcatcattatttctaccattacgtttctaagaagtaagaaccctccaccgaactcatgacacagataatagtatctcttagcctacctatttagtgtacaacgactggtgagatcgaacataatcaaaatcgcaaccgcatctttacaagccatgggaatttgatccaaggaccttttatctcctacacacgccacataatataaagtcaccgtcaataagtcaattaactcaaaccaacaaacccagaacactaaaaagaatgaaaactaaaaagcaaatgtaaaaactaaaaagtacacacagataaaacagagaaaaataaagggaaagaaaggtaaagtttaagcaaagaacctgcaacatcccatattctaaacgaaatacgagctccttgaacagacaaagttttgtccattagattcaatccttccatctgtaagcttctcttttcttgctcattccccacatacttgatctgagaataggaattcacataaccacaagctagttaattagacccgttaaaataaaagactactacacttgaccaatttcaaaagaaataaataatatatgtagcgagaatctaatcacaaactttctcatatatagtaaatttgttaattctcatgataaacaagcttaagaattttataaaagtaattttttaatattacataaaaaaattgagtgctgagagtattctggttgagagttagatactaatctttggagacaaaaacagtctcttatatgcatagacctgaaattgaagcctgaatacaagcttaagattcctgtttatttgttaattatgtcataccatgttgataatgatgtaaaagtttttaaatttctagtacacacttgttaaattcttccaaaaacaaaaacaaaaaagaaatggtaaagttagaaacatgctgaccacaaaagtagtttttccaatatggcaatcacccaacaagctgatcttgaggttcaccaaatcggaatcggagtcatagccgccagtaatggttgcaacggaggagaagacgtcgtcaacggtggccaacggcgaagaagaggtgtcccggaggggtagtttctggtagtgagatggccttccggcgacagagcaaactagaagtctgttccaaatgaaacggaaaaagtggccaacgaaagatacccttttgaggacaccccaccggacttcgacctgaacgattttccggcacagctgagacatcttcctagtggtgtcgtgaatgatcttcttcgccatcgagcatggtttcttctcggtgaatattcacataacagatagatagttagtacctaatcttcttctttgtagttcttcttgttgcggtgcgtttggtatattagtctggtttctcggtcccactgtttaatataggggacagttgaccggtatttttcatttcggtttcctaaactctccgtattgccgccttcttggtttctgcgtagagatgggtaatatggtaaatgaacctgtagtagggggtgtgcaaaaacctattccttacaaaaaaaaaaaaaaaatcgaaccaaatttattctaaactgttttaaccgattcaaaagtccaaatagtcaaattattataaataattggttcgaaaattgaattaattttaaaaaataattgtaaattaaattgattttgaatcagttttacatcaattttaagaattgaactaattttgaacgagttttaggactgttttatttttataaaaaaaaaaactgatttagatgaaaattggtttattaacaattaggttaaccgaacctctttagtacaataatatagttctttttattaaaaaaaataatttaagtgaaaattggttcgattacaactcgatcgattcagtctgagtgttttcttacacacccttaacctgtagttgtagtaatatttatacaaatatatttttataaaagtaaaaaaaaaaaaatcattagcactcattatttttttatcacatcatattttttattatataatttttttttctgttttctttcttccactcttagatgtcaaaaaggttcgtggatgttcaagaatatttgtgttattttatctcaaacttatcccttctcttatcattttatttattatacaagaaatcgaacaagagtgttatggggtgtggtatgagacaagtatatgtatcttaagctttctcaattgtcatgatgcattcggcatcttatgggggtgtgtggtgttaaggatatataggataggaattgaaaaaccgagtgtgatgactgatgaggagttatctgctgtggagagggcgcatgatgtgaccacgtagtctaatttcttgtttaattcccgtgctttaaataataacattcatgactgaaagggtcggaaataattttattttgatatttcttgctgattattattagcattctagtattagtttgaaattgaattgaagacatgatgagaatgattacatgtattaaaggattgaacgttagtgaatggtgacgttcttctcaaaataaaaaataataaaaatacgactgcactgtttaagagtttctaaatcagaggttcatacttaatattctaatcatatttatcctttttgaaagaaaaaaaaatataaaacataattatatctttaatttgaattaaatattttataagctaaatatatttgttgaatataaagaatattccaccccattagtacaatgtattattattaaaataaacaatattataagtatttgatttgatattaagattataaaattaacaatgtaccaaaaaaattataaattaaaaaccaatttgaaagagtgtagaatttcttataaaaatattatatattttatgttttaaagtttaattacattttagcatgaaattatgaaaatatatactgttatttaataatagtagtaaacttaaacgcgtctaatatttaataaaatatctactaaaaaaaactaaacatttaatatttaacatgttaaacacgtctagtatttaataaaatatttaccaaaaaaagcaaacgtttgttatttagcatgttaataacacacaaatttttatttagcatgttagacacgtctaatgtatttgaagttaaacgcgcttttgaattagttttgctaaagtcaattacaaatgataatagtaaaattaattaaaaagaaagaaaataaaatgtttacatttgatttaggtgatttcaaactaatttaaaaagtgaaggatagaccatgattagattctactagatttatagtatttaactaattttcacattaggaattgcaggtagccacagaaccgctaattatattagggttactgttattattagtggaagtgggtacagtataccatcaatttgttggtatgattagacaaattacagattgctgctctgattggtggatctaaatctactgatcacactgagagcataaaagtgaaaactacatttgataaaagaaaaggctgctgcaaccctgtaatcttcctatcttttccctgacaccaaaatgtatgattcaaatttaaaatatacattataaaattaaaattaaataaccaactacacatcagatgtggacatactatatgtatatgggtctcccaattgccatgcattgattctcctttaaaatattattacttgcaggtcatatttactcaaaattatactatagatttgtagataacattacttacaccagcgagaaaataaataaagtaaataaaaaataggatagtaaaaaaatggaaataagagtaataaataagaaattagataaaattttagattcttaattaggtccaagataagtaaaagaaaaagaaaaaaaaaatattatgaaactgtttgatttggatagaagaagaaaagtgaaattagattagatataaaaattctattccatcgttgtatataaactctaaactctcacatatgaatattggatagttataggatccaatttgcaggacataatagattatctacgcataatacattattgggggcatacataacaaattttagtgtgcatataatcgactatagtatcacaaataatagattatcagagcaatggggcatgcataacaaattatcggggttattgtaaataaagtagagaagttccgttggcttagggtgccttttagatccacgtaagctttggataaacatggatccagtatatattaacgctaatccaaatatgcggttagattttttgttatttcatcgctagttcatatgaaatatttctacggtgaaacctacttaatttttatttcttttttcattatttcatcttaaccaaaaatagactcaccaaaaaaaaaaatcttaaccaaacaatctaatttttaactttcactttatttctacactttcttctcaatttcttattcgttttattcttaacataataatggtgacatcataatttttttaaaaggaacaatatatcgttttacatttattttgatttcaaaattaactttggctcactttactgccacccccaaacattagtacagcaatcgtggtttttgccttcagatatttctgtcttttggttacactggaaaatatgaataaaaaaatgaaatgatatgtcaaaaagaaaagcattaaaatgccactctagttacgaggcgaaaattaaaactgcctttagtttttttgtactttatttatttaaattacaaatatttattttcagtatttgaatgcgtctatggtctcggttctaggaagtttacattgctttgatttcaacatctagatagcaaaccttggtacgagatagatgacacctcgagcattgtgtcacactttttaaaaaaaaatacttaaataacataggcacattaaattttatcaaattgtcatgtggcctatttcgctacacaatccagcggaatacgtgaattgtagcgtaattctggtagtcacgtatttcgctacagagatcagcaaaatatgtgatcaaaacgggcaggacatgtggcagacaggagttatttcactgaagagcccagcgaattatgttatgatggaaaagaaatcttaaaacttcaaacggttataacttttgatagaattgtccgatggaggcatacgatatgtcaaaccactcgaaatttagagaggaagccctgggcaaagtcccaaaggggatttgctccactattttttttttcttccaaaaaatgtctttaagtgcctcaaaattaggatttaagatttaatcattcaaaaaaattcttatttttctttctttttaattatttaattagttaatttaatgttatttttatttttttaattacttatcttaatttcaagcgttttgacatatcatacgtctcaatccgacatttctatcaaaagttagaccatttgaaggacatatcgtacgcctaaatcctaattttgaggcacttagaggagtttattggaaaaatagtggagcaaatcgcctttgggactttttctaaggcttcctctctgaattttgaacgttttaacatatcgtacaccttcaacggataattctatcaaaagttatgaccatttgaagttttgagattttttttccattgtcatgtaattcgctaagctccctagccaaatacctcatgtttgccacgtgtcctacctattttgatcacgtatttcgctggcccctataacgaaatacgtgaccaccagaattatgccacgtcagttcacgtatttcgctggactgcatagcgaaataggcaacgtgacagtctagtaaaatttactgtacgcgtgatgtttaggcaaatttttttaaaaattttgctcgcttggtcgatgaccccagatagagaacaccacaccccttcagatcttaaacctatttgctattaatttattgtggaatatttgtaattccaaatgttgccctaaatgaacctagctatatccatgactgaccttatactttacttagggatgctacccttttttgaagtttgtccatctataaaagtttagactatagagcaaggtatctagctaaagttttattgattaattatataaacccaccaacctatctatctttaatatattttatatgttttaatatgaatttattttgttagttacatagatcatggagttaggataatgtaatgaaatgaacgaaaaggttctcaccaaactgacattagtatatatatgaaaccactgctaattactaagtataattaatttcgctaacttacacgtaactacgaacactgtcgttgataattaggtttactaaattgaactcaggatcaactaactagaattaggtttactatagtttgcgttggatgttgatgcctagaatacgaacatacgtgttgacaaacagaaattaagaaagtgaaatgcacacgacttggaattatgcttaattgcaaaacctgtaatcggtgtaattgagtgatggggtcctttgtaaattgatttttgtgttatttgatcgtggaagtttggtaaagtttcaaagtgtgttttgtaaaaattgggatttttgtcttcctaaagttcaaaaatgcgtgtattgtacgtgaaatactttcggtgggttggcatatcatctttatacaatttggaaatcttgcacacttcatttgttgagaagaacctcaaaagacacccttaatagaatgatttttttaaaaaaatataagcactcaaataatcaactatagaaccataaaaatttaacttatttaattttctaactattgtttttcttttcaaattaagttttttttaaatattatatatactcgtggacataataaaagaaatagtaatattggttgtttctacatttattattttaaattatttgaataaaatacagtgacctaaaaactagcatgtgcatgtcaatactttatttcttatacaatgacaatctatacaatcctgcaaggatctcctctacttattcaatagtttattatatcttgtaatacgtatgtttcacaattatcgtagaagaagaaaaaaacctcaacttttttttatggcaaataaactcgactgagtatcaatatctgaaaaactatcgtccccaaagggatttttgagcttaaaagagactttttcttccattagttttagtccacaatatgctttgagaaaaaaatcttaacaagtagggtttttatctaatttgataattagttatgtttaacaaaaatacttgataaatcaattggaagttataaaaagttttaaatatatatgtttttatgttgaatttgaactcttattattttttatttacagatcaaatattttattaaaaaattgaattaatagtataagtttttcgaataaatagtacaaaaattaaaataagtaatatagtaacaaaggaggctatatattttattaaaatattaatgataaaaatgaaaacattatgttaaattatacgctacaaattacgttattttaagtagaaaataaataaataaacgttaaaagttaatgagataaatttattgatcaaacacgtatactttagtcaaataaattcataaagtaattaaataagttattagataactataatagtttaccaaactcactgaaagtgacatttggttgttaattaaataagattaatgtggaaatggaataatacacttgatcgaattcatggatgagagtaactttatggaaaacagaataaagcaaaannnnnnnnnnnnnnnngttttttttttttttttaaaggttgtctataacctatttaaaatgaccaaatctaacaaattattcccagaacttttcaatttgttcacatgttttctctaaatttggcgttagccattaactctcccactatttatttttttggctttggtctcgtcaccaccaataaagaaaacggtttcatgagttgaggttactgcctattatttccttataaacccgaaatgaacaacgcaatcaggaattaattggaaaaaaattcacttctcttaaattagaattcaatcactattcctaatgtcctacaagccgagcgtacatacaagcatgagcaaacacacgacacaaataaacctacgtttttttttacattaatgttatgaattaagaaaaatcttaaacaaaattgttctcatattttaactagctgagcaaatgctttctgacttcttttctaatttaaataaataaataaatgttaattgttcaacactccttacatacatttactaatgtgtaaaaatattaagattttatttgaataaacatatttatgagagaggaaaataagataaaataaattcaggttctttcaaaagttaaaattaacttttacacttagttgtatagaagtttgttttttcatttaatttctataaaatttatggtgcataagttgattttagattatagagaagttcaattcattttatcttgttattacactcttcctaactaaatttttattattagttgaactttatagaaaacaccaaattgctttggtttcactttttatttaaagaaagtttttatttaatcaataaaataatgtatgagaaaaaagtgtgttagataatatcctgtgctaacactcatctttattattatttggtggtcagaagaaaggtgttaggatcaactgttagttagctttaagccttcaaccgaataatacagttagttagttaaagtggttgtacagttagctcatagattgggccttgaatgtccagttcaaacaggcccagtttgattcatgggaccttggacgacgatgtttcaagaggatttttgtcatgaaaccaagcagaatagaaagttcagaatgggcaactgtggacaagtgaaaaggcaaagacatggtagagcttcttctacgagcatcacctcctccacctcacccttcttcttatccgaggtaacaaatccaactaatatgtccccattttcatctttagcaatatttaatgttctatttttgttgctcaacttgtgtttatgcccctttatttgtttttccattctggaacaccccttagatttttcctttagaattttctcctaattccaagtattttaacaatgatttttttcccacgtttgttgcagactcttttttctgtttttttcttacatttaattttcggttccttttatttttggtggacttcaattttcagtttatgtaatgtagcttttccatattcatatgcacagcattcctgaatgaatttcctttatatactcccagaattttgtcgtgtaataaccaacttttagtgaattagattgcagactctcctttttttttctttgtggtcctcctctttcattgggattctaagtgcatttttttgtctcttcatttgtagatactgttaaatatcaactctgttgctaaaacatgatactcactcaacctgggatcgcatgattttttatttttatttttctaatttatctttctgttgttgtgcaaattggatgacattttgtttacagacaatgcaggacagtgtcaggaaggacattggtgaagttctcattggaagtcccaagtaaggttctgacaaggcatgtcttatctgggcttgctgcttccttgatatttatttctccagcaaatcaggtttgtactgtattccacaatccaagagtgttactacttactattgaaatttcagttaatcatgcaatttcaagatgtgatatgtcccatacccatcaggaggacctacttaacgttctcacagtattttttttttcccaaatacatgatagcaaagttttaaattgtggtgacaattgtagtttcatcgtgatccttgatgttgcgggtaatgtagacaaatgcaactgatgtggctgcaattgcgattgcgattcagttgcagtgactctgaaaaccttgatgctgtggccgaaatcgctatcacaagttgtttgttaaaactttgctgatggtagtgtctagagactttagctatagtggttcataatcttttttataactccataattacatggacattacccaaagcaaaagccattgctattaaatattaattattttgcattatttgatgccattactttcttttgtggatctctttactcgcatagatattttgtatcactcttgaatttttcccatatttgagttcttacaaaggctggatattgttgattgataaaaaaatctagaaaatagatgtatattcttatgatgaatgagctgatctaatgtgtactcatttacttcattaacagactattgcagcagatctatctcgtgcaccaaataatatatgccaacttgccagtgccagtgagaaagcagttacttcaccatttgagaatgaaaaaggttcaaatctaatgatgatgagaggaatgacagcgaaggactttgaccctgtaagatattcaggaagatggtttgaagttgcttcacttaaacgtggatttgcgggacaaggccaagaagactgtcattgcactcaggtaaatgctaaaataaatatagcagtaaatatacaggacgacatttggtttagaaaaagcccattatatttatgctcttccaacatctttccctaatcaacttcatattattcataataaattgttgaatttggaggcacagacagaatcctaaggttgttcattatttattaggcgtgtgtggataattctgtcattcagtagtataacagttagtacatcttggagataagatttatcatttaccttatttggcttcgacaagcttcttgatactaatttgggtatactatgacatttcagggtgtatatacgtttgatagggaagcaccatctatccaagttgataccttttgtgttcatggaggccctaatggatttataactggaattaggggaagggttcaatgtctttcagaagacgatttggagaaaactgagacacagctagagaagcaggaaatgataaaagaaaaatgctatctccgctttcctacgttgccattcattcccaaggaaccttatgatgtgattgctactgattatgacaatttttctcttgtttccggagctaaggataaaagttttattcaggtatttactgaactaaaaaatatagcttaagtttgtagtcattgagcttcaaaaggctttttctgaattttcaacgatggcatatatgacatctagtgttaatttattatgttaagataaattaaagaaacaatactgcatcatacagttctttaattaatagttattaattagcatgtaagtgtatgatttgattttgcttgtagtgttaatttccctgtgatctatatcgcagatatactcaaggacacctaaccctggacctgaatttatagagaagtacaagtcttaccttgcaaactatggatatgatccaagcaaaattaaagatacacctcaggattgtgaagtaatgtccaatagtcagttggcagctatgatgtctatgtccggaatgcagcaggcacttacaaaccaatttcctgatctaggactcaacgcccctattgcgcttaatcctttcaccagtgtgcttgacactttgaagaagcttcttgagctttattttaagcagtaactatgttttgttttaatacattttgttttaatacatgtacttttgtaacgaatagctagctattcttgatagtgcctgtgtgtatcatgtaaagtataaactacctgtatctggtgtcctgtgtatattgatatggtgttttatttttccctccatcccaaaaataaatgtttatctaaaattaaatatcgtcctatgttattttatacagataaagaaaagttattaaatagataaaagaatagtaattttataaaattaatcttaagattattattacattaaaaaataaaataacatttgttagggatattagtgaaaaaaataattaatattatattgaaaagttaaatgtaacatttatcttgagataattttttttttttttaaataagacacgggacggagggagtaacatttgactatttgactaaggttttaatctgtgttgcggaacaagttaattggagacggttttcactctcttgcagtcttgcttacctgaatttttatgcaacacttagattgtttcactttaaaatttatatgaattcatattgccagttttcgtactaataacacctcttataacttttatgttaagtatcttacaagttgtacccattttggagtgcatatataaaattcattttatgaacatatatacaatatacagaccaaaataaatcagcatttgtaactagaaatgttgttttccctctcggacttgcttaaaccacataatcggttatttgggaccggagaggagtaacgtaaagcaaacctacataataattgttaatgtttactaaagcaatttcgagtaccccttggaattggttctttttaagttttaacattctctttttaatgtaatcgttgtccccccggaaagcgaatattgacgtgtatgattacaagtgtcaataataaaatcactaagactgtcatatataaagtcgtctataattaagtcctaaaaaaagtcatctaaagttacaataatactatttgatacgaaatcttttattaaaaaaatgctataaatgtctcacgatcaattgttttgtcaaccatcggggtagaatacacgtctttaacataaggagttaaagaatgtatacggttgtagggtcatattgataacttgggtgtagatgttccaagccatattcgttattgtgatagtcaatgtgcattgaatttggccaagaattttatctatcaatctatcattttaaaaaataatcaaaacatattgatattaggttgaaagtaactcaagatgatattaaagataagttgttctccatggaaagatagccattgctgaaaattaatggatatgttgtcaagtcctgtgtctactgagacgttcaagtataatttggacttggtgaatgattgcaaatagcttgagaccctttgaagtcaaggtgaagaaatgttgatatgtattttgctaacggggacaatccaatgttgattacattgactagatcatgtaattttttttctacatttttatttgtcctcatcttctgccataatatgtttcaatgttgggttcctctacagtattgtgatcataagaagttttattttggttatatgcattatcattcatcactacgatgatgtaaatgaaggcattatgcttggcctatgacaacatttagaaagaggagaattctgttgcacaacactttgcaaagtcgagaggatttttttcttaaaaaaagttttattgattttattgcttttgatttaagatgtttgaattgagtaaaagaatatgattagaattttttcttaattcttttcacacttaataattattattgtacaattacattagtaattgaatgacttgaaccaaacaaaaataaatttgttcggattacttaaaatttaaaccgaacttgattaatcgtcttggctttaactttcatattatccgatttgagaacccaatggcctcacctatttatagttgttttgatctcctcaacaaaaagataggtataattttgaaggaactagtatattcttaaaatgcacactatatggataaaatagtaaggacctggtccttttcgtgaatgagacactccttagctttggttataacgattttgtttttccaccttatggaatgaaatctatggccaagaagtgaaatgaactacccgtgagtgacaccaaagcaaaggccgtgacgagggtccagtaggattggcggttggaagagtaaggcacaagttcctcaaacttgctctatctctttttggtagtaaagtagggtggcaataaatttatgcagataagtagaataaagggaagaaatggattccataacgaagataatatttaaatataccaaaggaagattcagctaacacaaatactatagttgcaaatcaacatttttttagattcggaatttaattcagagtgttttcataatcaaaagtgataagactaatcttttaaaaaagtagagtactatttaaagagtaattcctttactcaagaatacttgttttttctcataatcaaaaattaaatgtctatcatgtatttaaaagactcaagctaatagtcacttgtctcacaccttgtggatgcaaattaagatacatgaatcctgcatcttggttttcctaatagcatggtttttggcttatttcaaaatagcaacttaactcattgatagatatagattcgtaaataatgttacatctttctcacactcctgcagaaccccatatgaaacaaaattacaaaatagatggagccaaccaaaataatccacaattcccttaacctgaaaagcactcaaataaatagttgctttcctgatttaattaacctactattccttgccaactaaaacaccaatttacttaaaaaagccaatggaagagatcgtcctacttttacctttcacatgaatcccatcagatccagagtttcaaataacgacctagctagtagcatgtacttaggaacatgatgaaacttaaaaaggtggcacagtagttaggactagagtgttataactgcaagcacatgaatgcagtgactatgtcatcaaccaatctcccatctatctacatagacctatgccatggatttcagtttcagatatagaacataaggtgaagcattcttgtgaaaccacatctcctgtaacaaaagaaatgcctcaaagtctctgcagtttcccctctagaacaaacccacaaaccacccttaaatcaaaagattttgctttctccccaacaccaaccaacaaaagcatgcataaatccactacccttgactcaaatgacacaaaagataaggataaatttcccccagtagaaataggaaccagaggcacagttgcatcactcataatgcaagaaattgagtacttcagcagacttggttccaattcacaaaggaacaagtcccaaatcacagaggtgagttcatccattagtacaagttctacaaccacaattgtatctacagtagaagaaagtacaaagaaaaagagaggaagtagcaagcttttaccaagtatgtgttctatggtggatgtatcagacagtggtaggccaaatgggacctcagccttcagttacaggaacctgaagtctgacacaaaaaaatttcaggtctagataatgctctcggatagcttcgaaaaaccgagcttcttaagacgacttgccaaaggtgtagcccaagccttttctgaattcccacattttatgtccacaatttcaacaatgttaggtatctttttatcatttttctccctcactggagttctgaccactgaacatttatcagaacctagcatgggtactctctgtgtatttctgccattagtttttgttttctggggcatgccattgccaggtcctctacggtttgtagttttactgcttccactgctaccggcttcaactgatgattttctttgttgtagtcttttttgggttgtactgccacagggaacagaaacaggaagtgtttgagttttacttcttgttgaagatacctgcttctttgatgcagaagagatgtgaaccaattcccttgtcattaaggaactgattgttccagtggtgcctagcttgatggatcctcctccaccttttataccttccagactctgagccatgctcctattagtaacacctccaattcaatatgcaaatgttccagtctttgagatgaatgctcccagcagaattattcagtgatctgttacacttacaaattagtgtcaccctgtgatttgagatgtaaagtcataaatttcttacaaattatttggtttggtttatctttcatgtattaagactatgtttgaataaatttctctacaaaaacttatagaaaataaaatatgaaatgaaagtaaatgaattgaacttctttcattcaataaaattattttatacactttaactttcccagaaattagcttctataaaagttaaagtgcaaaaattaattttagtttatgaaagaagttcgatctattttactttcttatttatttttcctataagtacttaaagataaatttatccacacaaagcctaactatagaaataaagagatatgcgtcataattttcaagagaaagagggatggggtggagagttactagattcactaacaaaaacatagttccagcatcaaatcaacaacagcagaacaacaattctgaaataattcaaaaacattatagactgtacatcacgatttcaaaacaaaacaggtattcatacactgcaatgtactctctttgtatgccatgagacaacaacaaccacacttcataacttcaggatgagaatgccaactcaactataataatttatcatggaaacaaggggagagaaaaagaactaacccacatagcaaaaattcactaccaaatcacaatggttgggatgaagcagaatcaaatctaaaacactacccacattaatagaaccagagaaggataaaaggaatacagcttcaccaaaagacaagctaaatcaaacgcaagaatcatcaaatttgacaaactaaaataagcatacatacacaaacagaaaaccaatgatttcgtttgaacaaaaaggcattaacttcaaattcaatcaaattgcctcacttcaaagtgtggaaatctaattctaacaagtaacactgcagaagaaagaagcaacattttagatccacaaagagaggtaagatcaaataaaggaaaaacaaagttgggtatcatacacatagcaagcttatggctccacacgcatgaaacttgcagatttgaaacagacccaacagaggtagggaacttttttgctaactttttgaactaaaattcagtgaaattgaaagttcggaggcaacgagtttgagaaactgcctctgttatagaaaaaatcatcatatcatatctaatccaaccaactttgaggaacaggttctgtgtcttattttgtagcgtgcgcatccaatgctgtgttgatttgactcacaaacatcatcgtcgtggaaaagttaactttcccaccaaatattcactactcattatggagaaatcaaatcataatcatcaacatagaatactgggtggaaattccaaatggaatgccactctctagcactatctttcttttattacttgatttaatagacaaactgctaaaataatttgctacaataagttagtaaatgtagatggatgaattaatgatgtcatatttttttttcttaacccttcactttttattgaaaaagggaaaatggactaatataaaaattgtctgtcaaaattgaacttagttctatgattcaattttaatctgaaatttatgttcaatcactcaattactgattacaattgtaataaaattgtatgtttgaaataagagaaagaaaattataaagtaaataaattaatttttttataagttaaaatcaaatgacgcaatttaatttttatataaaaagaattcatctaaaagttgtgatatatagattgattataatttataactttattaattaaattgttactaaaaaaataatccaaaacctaactttgagatcccaagagaaaagggaaaaaagtcagaaattggggctgatgagttcacagttgggcagaagaagaatcacgtggtcacaaaccggccaaggcgacaggatccaacttattacttacctgccatcatcctaaagtacacgctccactctattgtagtactacaatgttatcacatgttcataattttatatttaataaaaatttataaatacgaattacgtgatagtaatttttaaattatcagaacattttataaaactattatttatttaaagaatattcaatagggtaacttattattcttctaatggtaacaaaaaacaaaataaacatttcaacacacttgtgtttttttctctcttcataattgaagaatataataaaagtttatcacaaataataaataaataaataagagaatttaacataccacactatgactctcgagaataatttttaattatgataagaatttatttactttattattattaatgttaattgctagttacatattttcccatattctttttcttaacgcggtctcttttttatattttttctaacacgtttttattattaattaaaattattggaaattataaaattgtttgagtcttaccctttatttaataagttcactcaaaattttgtagttgtcgataaattttggccaataaaaaaaaaagaatgtgttagaatctagagagtgagttgctcctctttattttaagaaaattgatttctataataatattcattattttaatttactttacaactaaatcactaaaaggattttattactgtaataacaacttaataattacgtttttgttttgttttttacatatatcctctttacagacaatttgttcaatgtacaatttcatagtgcacctcttccaacaagaattcaaacattagttcatcatattatgagggattagaagcttatgctaaacccaactttcgtcagtaatcacatttaataatttgcaaaaaatcattggatgtcaataatgaaaaaaaatgaagaaagaaaaggaatggaaagaaagtattttgtgtttaatttgtacataattaaggaagaaaaataaggttttggtaaatttgattatttcgaatttaggaagaatgggggagtgtgtaaatttgagttaaaagaaaaaaaatccttgaattataaaatattgctagttttgttttattttatttaagtgatgattttttaggttattattattttttaatttatcttgtaccttgactagttttttttttgtattattggaagcatgtttatgttattattttttattacggtttatttccctttaaaggtatttatattattttataatatatctttgtttcttattttctactcaattaaattagagaaaagaaacttattttcctttcctttcactttatattctaccaaataactaaaagatcattttttttctttctttccacttacgaaccaaacatagtatattttctattcaccacaccattctaggtccaaatcctaccacatgccctatacaacaagcgcatggctccgaagtccgtacgtttggaaattgcggcttggaaacagacgcaaaacaatactttgcactgaaattaaccgaaaacgaaacgtctatttggatttttggataaaggaaatgtatgcagtgacaaagctttttatataaaaaatatattaactcttatattttatcataaataactaaagcatataaattatgtgacttttttttaaaattatataatttcagtaattatgactttaaaaaacttttcatttatctataattatgcagttcaaatttacttttgaactctccacaaaattcctctcgcaataaatatacttaatacaatgtgtcataaggtcttcaagaacgtcatatccaaccagcattttgacacactctccgcgtctcattatggagtgcacatccactgctttgatttgattcatatcattgtggtaggtgtgccaaaattagttttccccaccaaaaatattcataattcagtacgaagaaaacaattttaatcatgaacataaaaatagtgggtcgaaactggaatgcctttaactagcattaactttcttaattcaatggtatttattattaaattttttatttaaactcaagaaaaagtgaaagtttgtgaaaaataaaaatgaattatgtttaataatagaacccacttacgatatgtaaaatgtaaatataaaaaaatactggaatgggaagtgaaagtttactctttcacaaaaatagaggacaattacgtagtttgcactacatggattttatatatgatgatcaaatgacaaacttttcatcaaagaataatcaggtaattagctcctgcaaggcatgcataacgtttaaagtaggtccatggtccattcttgtaggccatttttgcgctcgttcataagattcataaattcatttgtacagaatatcataaattcataattctgcttgatattactgaaagttgtcaaccttaattgtcactggctatactgatcatttgtgcatgcaaagtgctatttgagcgtccaattatcattgcatgatgtttctacaaagaagtatatgtttgcaacagatcaacagaaaaatgcagatagattctttttataataatttatatacaatattgatatagtttgcatcatcagaaaacaacaaaccggtacatgatgcaaggcatgaaaaaccggtatacattcaaaatatagaagcaaaaaaaactgctaactagagaagtaaaacgccgaggccagtggttttggcctttttcttccttcaaagcaaaaacgtgttatgctttggtatattatcaaaacataacactggaaaatttcctaggatgtcaaaaacctctatagaaatcaacctcagataatgatatttaaggcataccaattctgccttgaaaatagaggcaccagagtagcagtatcttttgattgcaattaccaaaggaaccatgcagccaaagatatctgaatgagaaaaaatctccaaacagttgtcatggcttttcatgctgtataaaggactaccactatttcccagagtaccagttttgagcacacttggcatcaacagagaggtcaactttaagaatgttcttgccgttgaagggtttggacatgcactcaacaactatggacttcgcaacctcagctgattctgttggtccttccaatatgacttcatcatgaacctgctttgacatatccaagaatcttagtgaaaaagtagcaagattggaatagatatctgaacacattcagatttgaaataacctcaatatcagaacatactgattaaaaataatggttgatagaaattgtaactttatggttactaatatcgtttaattgcttttagattaaggaaattgcctcaagttggcaaaacgaactacttgttgtggtggaatagttcaccaatggaacaagttgtaatgtaactgcaattacattggttgataacaagaactacaaccaagataatgtcattaataatcaacaggaaaagaagaaaaaaagtacggactacataggtatcacttaatttctccaatgatccatagaaaatgttttgagaagacagatgcataaattattgattacatagtaagcttatagaatatgagtcaaccaagctcttgtttgcgtattacttaatgcttattcctccaatccccctcccaactcagggaggaagaatggatagaattgcttgttgattcaagactctagaataatggcaagtgagataaggtgtnnnnnnnnnnnnnnnnnnnnnttttttttttttttttttttttttttacaaaaaaaggaaatttagggggcactaaattacctgtagaagtaacttccacccaagctccttcaaccgtttattcttggaaatttgcaacatagcacacatggcaacatcagctgcactaccctgttgaattctacaaatcagaaacccaaaaagaaaggtatgcatgtgggaatgggtcacatggtaatagcatctccacagaaagcattgggctattatgagtcagactgaatcttcaacatttcagacagcacgatagggatttaaatgacaaagtaatgtatttatttcaagaaatcacgtaacctcaagccattatccaatgattaagattagctcataccattaccactccacaagggcctatttacaaattcacaatctccccattcgcaagtaacatgatgcatgaacagcaatgaatagtttctactaaatgtaatttttgtcaatctaacaattgaatcataattagttataaataacgatggtgtaaaagctaattttagataaattagacattatcagtatatttaatcaaatagtaaataatttcttaaatttttagtaataatatatttatatttatctttacatttacaaactaatggaatatatttacaaattctatgggcattgtaataaaccaacaatcccaaaagctataagttgttaggtaaagacatatgttttggactatataaatgtactcatttttacttactatcaatgaatgaaatctgaattttatgattcttctttatagcttttatttgtaggtttaatggtgttttcttaggagtagtggtagagtagaattagcactctatccaatggtgctttcatcagcttactcccctcccaaatccaccacaaccaccatggaagacaaccttcaaggtattttccgaaattagatgccttccagaaccaactcaaccactatgaagaaaataaaaaatctcaccacactacccttctaaggtccatggattcctttcatgacactttcacctccaccgtgcatagcatgatgaagcaactctgctctcaatcttcaacatcagacaccacaaccactgccgcaatcgccgccactgtcgcaaccaccgccgcaacagtcgccaccatttccaccacaacaaagtttctcctctctgtacccttgctttaacaatatttcccatacaaccgttccactcatgaacattttccccaaccccaacccatctctgtatcaccttacccacttcctggtgttgcaacaaaatctattttccctacatcaaccttttcaatttttgcaaccccaacccaccacccacaatccccttacttcaccgttcactccaaatccacaatcacaatacagcaccaaaaagcaaccaatgttttgcgcttgggaaatttcccagccgcactgatatcacccgtccaatctcactgcaattgaacctaacctccttccccaatcacacccgtccatcatattagaaaataagacatctagatcaccatgtgtcctttcacccatgtacactcccacatcacagctggctcccactctctcaattgcatcaccagcccttagatctccaacgatccaattaccacacatctaagccattaaaatcccaccccaaccatgccacatacatcctctctaaaccatctccacttaccaaattttttcaaaatcctaacaaccatcaacaccatccatgtgtctcccttatcccacatagtgcactttctcataaagttatatttcccttccaaccactggatcaaaacaagtctcataagccttttcttttttcacgtactgccaccaatttccaaaacccatccacaattattttcttgcccccaaaagcaacatactcatcatttgcaacaagctgttgctctcaattccaattgttttcaaaccttgaggacaaggttgaatgtgaaccggtgggtaatgataggattggctctaggcccaaaattaaatggtccaaggattatatagggtggacttaaatatgtattttataattatagttttttttttttaatttgtgttagaataatatgatgttgacacttggataattattatccttgattgacatttttaggactacataaatgtactcagctttacttattatcatcaatgaatgaaatctgaattctatgtttatcttctttatagcttttatttgtagctttaatggtgttttcttaggagtagtggtagagtagaattagcactctatcaaatatatgtaaaggaaaaataatttcacccaataatggatttcaaaaaaggagattcctgatagggaacagtactaactagactaatacaagatgacactattgtaatgttaatacaatcaaaatctattcttattcacagctctatctggactatcatttcaatataaactatggaatatgatattttacaagtgggctctcaaaatgtgatctcatcattcattgttcttaaaagggaaaagttccaaactagacaagaatcacaagataaataattcagtacattttttatttactagagagtgtaaagacagttagatagatgagtgagggagacacagtattgatttgtttattagaaagagctaaggacctgcactggagtattaatagcagctcgctcaatgtgacctttctgataggtgttagcttgggccatcaaagggaaccgtcgagctctccctagcaatgtgtaaacacaatgtaacacgcgagcttcctttttacgctcctcttgccattgcaaaacctcttttctatcattgtaccaaaggtcaactgttttcttagcttctttcacagaaacctgagagtgaacaatcaaataataaatcaagggcaattttcacctttctaaatccctcataataagtaaaagttctgggtaccttccaatccttggaaagccccacaggagtcttcccatatgcaattgagaagttaagcattttagcttttcttctttcagaagcaaaggcatcctgacatggaaggaaaacaaaaatcaaaacatgatcaatcatgaattggatggttataagttataacattaaaatgctaaaacagctttcttatatcttgagggaagggcatcaaataacgttaaactgctaaaaaagcttattaatgcctggtgtattctgatttacttctgttaatatacataaacattattaaacacattatatatcaaaaaactcagtgaattcttctactaccactgcaactatgttttccccctaaacagtgttctaatgagcagtagctgtcctttatttctattggaaagttcacaagttatttgtatttgttctgaattttaataaagtatatttattctatttgccgttgatggatctgggtccaatcagaataaggattagtcctccctcatgcatctgccagcactctggtggtcactatatttgacgtcatcagctacaagaaataccaaactaaagactaagccactacttccacatctcaatgcaatggtacttctatcagcggacagttaccttcaaaagaggaactgggggtttatcttcaccaggctgaggatgccactcaagaagcacttcctttttctcaactgctttacgaatatgtgggtacatattcattgcagtccttgaatggaaatctccaccagcttcaaaagcttccaacatgctcttacagtctgcaaggtgtgccagaatcctaagttccagctgtaacaataaacaaggcagttaacagaatgaaatttcttgaaaatagttcaattagatagacaatatagactgttaacctgtccataatcagcaactataagagaattcctgggtgcagcaatgaatgcttgacggattttgtatcggtccttttccagagcaggttgattctaattcatgaagtgtatgtgttaggttctatattgttttgaaagtctgattaatctagtagatgtaatatccacatgtcaatgtcaaaatacaaattgaaaatgaatgagatgcattgtgcagtccaaatttaggatccaaatcattgtaataaagtaacagaaaaggcatcaagaccaagtagacataaaatgattacataaatgtgtattgcaattagcaaggctgtgattagtccaaaaacactaattttaataagatatttttaactgaaggaataaatgaatacaaaagaatgtacatttgagcagagatgtcaagaactgactcttgaccttgagatatttgatagatgacggcctaaaaagggttttatatttttaacatgctacctcacacaagaataattcaggtttgaaacacaaataatccacagacctatttcaccttctgctgaattttatttttttgttcaaccttactgccaaaatttagttaagaaaaacagcagcaaaaagatagagtggaggtccaaaatggacttatatgtctaataggaagaaaccctactaaaaggagaaactatattttaggttaaaagacaaaatgataaagccatctactaagagtttagcatcaaggaaactgtatgacaccaattagtgaacatacaagcacacagatgatggttaatggtcagatctcaaatgtatagcacttaaaaaaatttgaagttcacaacaactactattaaaatgaaaattcctaatcaaaaccattagagaattctgattaatctaattagaataacctgcagatttggccttcttgctgacaagcgtcctgtctctgtgttgatatttaaggaacaatgaacacgaagatcgtttcctgatatattatgtccctgacaaagagaaactgcagctattatagagcacatataaagagctatctccaatgagtattttaaaagctcaaggtactgtggtacttgtgagtttggtgcacaggtgagttgtcaagcatctcattgactgatgtttatataataattataattgtctaaaaatatcctttctagggaaaaaatagaaaaatatcatcaatttattacggacaatatgaacagtatggaagtttgtatactagtttcaaaataaaagaaattccaagcaagctcaagaaagttcatattgcaaaccaaacaatcaaaaaatacctgcaggggaaggatgaagttggagatcaaagagttgattgaacagacttgacataaagcagcaattgcatggcaagcttctctcccttctttctctgttggaaaagctgcataggctgtcccatatgcagatttatcaatttttacaggtgcaacttgactttgagaaggattttcatcttcatcatcaagatccaagttacaatcctcatcaaaaaagtcataatcagcggaaatacttccagccagggcctttaaagcatcaccactaactgacggccaaccagttgctgtgtacatctcagtctccaggttataacctaggcttgtcaactttatatcacgaaatttttttggagccttcttgccttcttcaatcacattatcaacattgggaattttgaatattcgttcagttggaagcgtctgattggagtcctttctgtaatgaagcatgtgacaagtgaaaatgaaaattttacttccatctatatccttcagctacttcgttgtaaacagaaaagttcataaatatcaaggtaggtaccagtagtagtaccatcattcatgaatagtgaatacattaatcttaagaatatcataaatatttcagcctttgactagcaaatcattaatttaagattgaaataaatgctacacgtaagatttaaaaaatgtgcacctgttcacaatgccaccaaaaagaagctggcgcaactgcgaatcacttcccacattcatatactgggcatcaggacaatacctagtggcccatttgcggaatctattaacagcaacctcttgctctgctttggccaccttttctatgcattcaagataagcccggtcaactagcattccctcagattccatcatgactagaagctcaccaaatggacgccaatattcattgtagaaatcatacatggttttcccataaacttgcaaaccatcaaatttccagggcatgtctgaaagatggctctttaggctttcatacagcttcaaagtgctgctagcatctaaggcagaataacatatccaaggtatgcgctcatctctctgtagctcttcaacaggagcaatgatacttgttttaccctcagatccatcctttttcaattttttcttactaaatatagttttcattgacaccttaccaatcaagtccttttcatggttcagctgagccctagacatgacccttctgtcacctgtaagtccttcaagagaataacccccatccaaatgtcttgaagaatcccataatcgtgccatgtgcattgtatcagcatgaaatcccgaaactttgaatccataattctctataacatgacagtcaaagctataattatgccagacctacagaatgcaccagtgactcggttatttcaaatatggtttgtaatctctggtcacgagcatagacaaacccaggaatttaatgccaatatgattttataaaagatagatttaattttctattactacaagataagaatatctaacaactatacaaataaaataaaatagaataacaaatcatgctagttcacttctatcataagatgaaaacttctctgttctatacaataaaaccatgcaccaactatcctaaatcaggtacacattaacttaacattaggaatgcaagttgcaacctattcttagcatattattgaaaaattgaatataccactgaacacacagtaaaaatcgatatggctctctgtataatatgacactaaacttttagattacctgaggttaatttcagaacagattgtagctgattgtcatatatcttaactaggaaggcatatttcatacagtagcaagcatagaactaatatttgagaagtgttgcatgttgaggagaggaataggattaagaacatagaagggatagaagaagaaaagttcaccttcttgatggaagaatcgctaaaaaattcagcaaatttttctaaaatctctttgcctccaccatcaagaacatctacccagatacaggactttccacctccaaaatcagcttctggaccacaataaatgctgaagcatgttatctccccatgatctacaggagtttcttgtttgacatctatcttggccacctttgaagacaataaaatcagcagataatgtgttacacaaataaaaattagttgaattcatgtccaaagtacacaaacagacacacgtgcacagaagcaacaaaggatataatctagctatatagactcttgtgatatggagtaaccataatacaagtaaatacagtaaaaagaattatacctcggtatcacatgcataaataagatgccggaactttgttgtaagcatcttagcaacttcctctgcaagaggaatattatcaacaaccagaatatcatcatatatactacaaagcctatcccggagctttgattggtcagtaccacatgcctgtttagtaagtgttacattagctgaatcctttgcagttccatccaaaccatgatcaccattgactacagggactttttctttaccaatccccaatgaagatccattatactggcgaatcaccctttcagaatccattaacacctttgaattgtttaatacagaatagttaacagaagatgggacatgtgcaccagaatcctgcagtacaatattgctatccccgttcttaggaacagcctggttctgatcaatggaagcaactccattagatgcactaaaactgccattttcactctcaaatttatttgagccattcatttcctttttattttcagttaacttatcttttgctatagtccagcctctataatcaccaccagacaaattttttcctgaagtggtttcggaaaattcattgttgcaagaagccatgcccatcgtcctaacttgggcttcacatgaatgcaaagagttcagctcttcctcctcagtcatttcctccaacgtgctagttgatgtatttgaagttttcatagatgaaatgcaaactggactcttgcacagaaaattatgcttacacctcacgccattgtatttatttaaccccgcagatatcccctttagacagcatgagaaatctgctctagatagtacataatttctaagcacagtgctatttcggagggaaatttggaatgacttcatttttcttctgcaattcacatcatgcaacaaaaataaaggttccaatcaatgaaatgtagccatctacaagctaagaaaaagcttcatctgtaggcatgtgtggtacaaagagaaaatatatctcttcatcactctattcccacatttactaacaaaagttaatccccgggtagcatccttaatattaacctatttcaggttttatcatcaacaaattgtcacagaagttacaatacaagtaaaatttgaaaagtcacacttgacttaatgttaataccagtctcaacctttcaaaccagtgaagaacaacaaggcacactgacccatagaagtaaagacaaaaaaacaacaatcagcatattttactgtgtaacataaaaacattaatttcttaagctaaaagcagaatacccagttggaaaagatgcaaaatttaaggacattaaagagatgggcgaggtcagaagcaacaaaagacatgaaatttgaagtgaaataaagataaaggaaaaagggtaaaccgttgcagaggctgagaaggtaaaagggaaggaagagagaagggacttgagaagcagccgcggcataaagggcagtgtggccttaaagcagagacctccattgaggcagaaatcacctccgactgctcctgctccctccacagttaaacagattaggagccagctacttaaatatataatatataaaaatatacatacatacatatatatatatatatatatttatatatatatatatatatacacacacacatatatatatatatatatatatataaaaggagacaaaatatttgaaaaaccttggccattaatataaaatacgtataaaataaaaccccaaataaaaataatgtgttataatatttaattgccacgtaatcttatgattggaaggctaggatgccgtctcggtcggcggaggcataaataggagtcttaggtgcggtttgacgtgcttttaacttaaaattatgaataaacactcatttttgtttttaaatttatatggtattgataaatttatttataatagatgaaaatttaattttttttccaaagttaaaaaaagtgcatcaatccattaacttcatctattatgattaatgaaaaagtttatcgtattctacatattcaaaaatgtattttaaatatttaaggataaatttattagtgttttatttaaaatataatttaattttcattttctcttttttttaattattacaaacataaaattataataaatatgtaatggcatgctaatgaacccaaaaaatggaacagtgtcattttgttatcaaataaccttcttttatttttaatgcttaattgtataatttataatccaaactgttattattttgtaaattttatcggctaattttttaatcattttatcatcttgtcttcaattttcacgtattttactattcgtgttttttcacattttattattatgtttttaacaaaatgacgtcatttttcataaaatagtaataaaaaatttaaaattttttagggacagatcaacactaaagtgtacaaaaattaaaaaaaaaatacgataatgaagcgtgcaaataaaaattggatggtaaaagtttcgaagtgctgttaaaaaaaaggcttgaagttaaaacaaaaattggaggtcctttttataaatttataaatacatctgaattgacagagaaataatataaagattataagatactatataacataatttgagaaaaatattgaattatgtaacctacttgtgtaatctatattatttattttcaatgttgttttgtttatgcaatgtttatttttacaatattttaataaaatttaattgaaataattgattatgtttttcaataaattatttcattaaaagacaagttaaaataaattgttaaattttcaaaatatttttcattgtctcaatgttaagattttgacataaaaataaataaaatatatgaacataggaaaacttataaaactcatttaatacttttttgtttaattgtacattttactacttcattgtaacaattatttttcacttagggtgcttttaatggatacaacataagaacaacacaagtcaagttacaagataattttatcttatatattatttgatggaaataaataaaacaaactaaataatataaaatttactgaaattttctttttaatattaaattatctaggtactatctatataattatgagagcatcatagagccctaggccatcttcattcaacccttcattacagtactgtatcctgaaatgggtgaattttcagacattacaagtgtttatgtgccgttgagagaggcaatttaaaggatgagaacgtagattttctttttttgaaagtgggaccaaaagagagcaatgtaatttattatggttaatttgaagacatttcttcagcgacttttccatgtgtacaagatgaattgcttccttattagcaaatatatatctttattttgtgaagatagaccaaagtttatgttaaagtgcaagtttatttctgccactaatgatggatgataatgttctttctgtcaaaccaaaaggaggtttccactttgaactggaaaccatttttcattatcatctgaaagatcagaacactcttcatgaaaccattttactctagataagccattttaaggaggaaaggaattgcattgacctcactgctttggttttatgatcaacaacacaagatatatggagtcaaatgttttgtcgagtggtattttccattatgaaagctgaaacaaaaaggaaacattgtaacagtattgattagagaatctcgaagagtaggcaattatgaatctggtaacaatcttgtcattctattatcaatatctattatctaatactactactcaataaatcttgaacatgcaaaaatatgtaaccgttttgatcgattttcataaggatgccaagtggcatcattaagaaattttatagaatgattctcaaacttcattagcagctgctttttcattcattgtccttttctgtaatcctctactgttttcaggttcgttttgtcagctacattccccatgctcgaaaaaagtctcttttgaacgttgttgtcttcccacttgtatatgcctctttgctaaaacatcaagagctgtaactacgtcactaatcaaaggtcgggtatctgcttcctcctgaatacacattgctgcaactgctattgcttggtgtagaccctttgttgggtagttccctttcagcaatggatcagccattgatgaaaatttccttctgtctttgaatagtggttgtgcctgaaaacaagaaacattatgaatgtcaattgctgaacatttgtgcatattaatggtctaagcttaaatttttggactagttttcatattgattagagggtaaaatgtgttttacgtccctcaattttcagtcaaagttaatcttggtatctacactttaaaaaccatgattttattttttatagtcatctctctttatggaacatatgatactagggtcagagacgaaattcaccaattacaaaaaatacgatgaccaaaattattatttttaaaatatggggactaaaaccaattttgaccaaaaatgaagggacttgtgatacattttgcccttgattagattataaatcctgaaattttaggtcagagaaatatgattttaggcacataataaaagcttcatgacatacccaagagaccaagttttgctcttcagatggtcttgactgatcaattgctcttcttcctgtgatcatctctagaaacactactccaaagctatatatatctgattttgtagtcaattgacctgttgaggcatactcaggtgcacagtagccataagttcccatcaccctggtggatacatgagttttatcaccagttggaccaagctttgcaagtccaaaatcagagagctttgggttgaagttttcatctaatagtatgtttgatgctttgaaatcacggtatatcacaggcggatttgctacttcatgtaaatattcaagtcctttagctgcacctgctgcaatgttcattctagtacgccaatccaaaggctttctgttcggaggtagttctgacaatcatttttcttttcttgttggtcagataacatttaacatgcttatcacaaaaaaaaattaaaaaaataatactagggtaatgttttgaaaaagggaacttccacggtgccagtcttgcagatatatttggtttctcacacaaatggaaagataaaacataatctacttaaaaccatcaatatgcaagttgttttatgttgtaactaataagtaataaccatgatgatccaatgtgctcatctggtcacactgccactacagactacacttagtttattgcatttattgaagtttgatactcaaattggatgttactctcatttttatccgtgatgcattgcattagaagacataagaagcatttactaaccaagaaggtgatcttctaaagagccattcaccatgtactcgtataccaaaatcctttgatcaccatctgcgcaataccctaccaaattgacaaggttagggtggtgcaagagactcaaaatcaaaacctctacaagaaattccctgtttccttggaatccattcctattaagtttcttcacagcaacaacctgcatgaaaggaccacagcatttagaagttttttcttagcataatattcacatagatgcgagttgaagttatacctgatttaggcttttgaggcgtcctttgtacacccttccaaagcctccttcaccaatcatattgtcagggtgaaagttccgagttgcaacacatagctcgtgataagaaaaagtctgagaggtaatattccctttcccaatttttgctatttcttcttctatgtacttccgtttgctggtatctacaagataactttgttcaagttttaagcatcggtattcatcattgagaaaaaaaatgtctgacaaagctgaaatccactatatagggcactataagaccactttgcacctttagcttagcaatctattgtaaaaagtcaaaactctagaggttaacaattgagacacaactattgaggtagagtaagagatccttaggtttatgataccctaattggtaaggataagactcatagctcacaaggatgtgagtttgaatcctgttgtcaaaatgataagacttcttcattggtacataatctgtaagaacttggtggcacaaattgtttcaaaacatgttatcaacaagctaagaacatcattaatgattaaactaggaagggagcctaaagagatgcacaagaatgcatttcacatcgttgaggtttcataataatcaaaaagttgatgaagcctattgtgatggtataaacctttcatggatttcaattttaggatttcatgttgagataaataagattgtgctagaggaaaataatttgtcgtggaaacaacattaaactgtagatatgagacattaaattgaaaaaatgttggcccgaaaatcgatacaatgagaaaattagcattggagcttggaaaaataccagatttaaaacacatgttggctaaccatggcagagcttttgcgtgatggtagttcttactgctccttttcaatgagttattgtcgatcttctcttgtgacgtgcaacatgaaaagaaactcatcttccactcctaaataactgatctaaccaaacccacatttacagaattgcaagttcatgcatctgtttttcaaatctgtctcttagcatgcaaatgttagccaatgatccaatgcatgcagtcttagaccctccagaagtggtttcaaatcaatttaggaagtttttcattgaaacatatgccctgcagaaaccaaattgatcctgagttctagcttcacacaaactttcccatatggcatggttacttttccttcattgttattcaaaggccatagttaggaaaagaaatgaatgtcaaatatgctaatccaaaaatgaccgttagggagtcactcatctttaatatcattatctaaagttcctcaatataggatttcattaagtgttccctcttaggttgcactttattatgccaaccaaaatggagaggatcactcctttatgaaactagtcaagaataaattatgacaactattttatatggacagcttatatctactttgtatccttcctatctacttcagttatattctgtttgattgagcatgtacctaaatttgtgtatgatctatacaatacttctttaaactttttgaatgacaataaactcacttaaatgatatgatgagacatcaatttttttttttttaaaaaaaaaattgagtttttacttaaatgttccttaatataccaatctctttaatagtacttaggtggaatattatatgtattatattacattttaaattataattttccccatctacatatctgtattcctaacttatacaaaatataaggattttttttttcactttgattaaatgaatattttcttgtattcttgttcaataaaataaaatatttctaatattttttatccatacaaatcgaagagaaatagtttgaatttataacaacaactcatatattttattcaatcaatagagctagaatcatcattttaatcttacaaatattagtatgctattatgttaatccttcaaatattatgaatctaaaatgtcactgaattcttctgtataaagtggtgacataaaattagttatttttattttttaatacatttaacttaccaaatttttggaaaaaataatatagcaatactctaatttttgaaggagaaaattaagtgtttagtttttttataaaaaattaaggaaagaaaagactcactctgtacacgttccaaagacaaggtacactaataaaaagccaattttgcaaggaaaattaatagttcagtcaaagttgatgttataacaaaaatcacagattccagagaagatattctttttgaaacatgcagtccaaattcaaaaattatttggaaaaaaaaatatgatatactgttaaacatgtgatatgccgaaaatttaaagttatatttttgttgagcacgtcatttttggaccaatatatattgttaatttttcatgaaaactggcagagggcggggggactgagattccaaaaatacagcaattgtgattctaattcctgttagatgaggtatttacatttatgctctgttcggatttggagatataaaaaaaaaatgagagaagagaaaaaggataaagaacaataagattgaaatattatattactcggatggataagtacaaaaataaagatgaaatcgtgtatttctggggtgggggagatgttttctgccatatgtatcattgttagaataatagtaggattaacttttttaatttttatgtcaatttatttgtcactggctgctataatatgggaactaagaaaaaatgatttaatttctctaaaataagatttctctaaagtgaagaaatgcaatttagataatgaaataaatacattcacaattatttattagaaacatcttaacttataagaacttttcaattgtaatatcttgttacaagttttttaattaagacaaaaatgctgaatttctaagtttataagtatttaaaaaagaaaataaataagattttttaaaaagaaattgaagtatacaagttaattttaatttttatataaaaaaatttaattcactttacctcattggtttattttatttcgtcttttacaagtatcaattcaaaatttcattcaataactaaattaaattaaagataatatttgctgattttgcgttccgtcatacgactctttttaccaacaagggttgcaatgatttcttccccattattgtaaccaaaaagcttcatctttgatttgaactgatgaaatcaaaagcaataaaacatagctagctccaattaaaggacctaaaatcgacaataatcagaagataggttcagcaatctgttcttagattagtgaaagcttgccctaattatagtttctaggtatctagatcacctactgaaacagaaactgtaaatgctacacgatcaggacattaaacatggggaaaaaattgaattaaattgcacaaagccatcgtgataaattttcaggtctttcattaacatggcaactttttttaggaactcttcacctgcctcaaactgtattgaataatgtatttatttacaattaaattcaatggtatccgttagcaataagtgcaaagggaacttcaaaaaaaaaaacaataagtgcaaaaggggaccatatagtgataaacaaaaaccaagcaaaaagggaaaatgtgtcttcaagataggcctcgatcgacttaataaccttcatctatatatgaacatcaactcctgtcctaaaatacggcactatgtggagcctaaatgtggtacaattggtggactgtggacatatatataagactaaaacataaaaatgattttaggaatatgaactggaacgacaatacttctgaaaagtgcaatgctaagtaaatttaaagttattataagccttcaaaagtaacatctaataatgacacaaggaatccaattataaccccaactaaaaggatttcaatttgctgtgactgtgagacgactatactcacatggaattagaagaaatggctccaattagtcatgtataccttctaaatctctgccagggcttgacttctcttagatttaattgttttacaatgaggttaagccattattaggttttaataagattggcacttggattttccttctgataaactctaatctttttatcttacattggatataatgctcacttgtatattaattttaccgaataaaatctaaattgtagattacagaagactacttttgttatggtaaactgattttcagtagcatctgtatcacacaaggctatgcaggccaatatcaagtgatttagatagctacatacctaagtagtaagtaaaagggaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgtgcctaatttcttcagttgaatctgcataaaacaccaaagttcaataaactttctgccaagaaacactaactcctttgtatcatataattcaatgcatgtgcctagctagggataatatatatccatttatttaagtataaaacaataaaataaaatgtacacaacataatactaatccaatcaaatattcaataacacagttttaacaaaacgtattacaagaattaagctttttctctaatagccaataggttctatagtgaatcatttctaatggttcgatcgtacaagcagatagcacaaacaatataaccataaattaaacaatttagtagggtgtgccaggcctacactgtattgcaagaaataggcgacacttgaatacttaaaccgattagaacagatactacacttgatcttagcctaaaggcggagaaaggcatgctttggttattatattgttgttgcttttatttctgttacatgttctgctgctttcttgactaactgatgtgggactctttggcgactacgctgctgttgcaaacttgcaatagtgacaatttgaaatgttagttcttctaatccggtctttcttctaaatgtgttttcttatttaggatgtgacagtgcgtacaaagtccaaacctagtttgctagctatgtgttgaatgtattaagaccttcatggaactactgcatgcactaaaggatgctatctgagaagttaaaagggataggatgactaatttagagacaactcattatattatggattctgttgctgggccatatccataccctgtgatggtaagagagtttcatgcagtgattgacaaggaaaccagaaagcaagctttggaaaaatgcataagaagccaaatgtgtgtgattgcatgtgttggtgacaaaaaaagttaggtaaggtgtgcggatttagcttggataattgcaagtatgcagcaatattaatttcagatatgtgatatatactaaaggatgctgcctcagaagttataagggatagggtgactaatgtagagacaactcattatattatgtttctgttgccgagccatatctatagtactataccctgtgatggtaagagagttccatgcagtaattgacaattgacaaggaaaccagaaagcaagctttggaaaaatggatagatgaaccggatatgttgaatgtgcaagttttttctctctagaaaacagcttggtgtcgaacctgaacatggctttttgaaagatttagggcgcactgaatatcaaagaatgactggggaagcgttgaagagggtactatcttgtgtgaattgcttattaaaaaaaccaagtactatatttgaacatgtttaaaaagtaaaagtgcatacatattggccaggactgagtattatatttcaaactccttatttaaaagataagtgaaaagaaatatttccaacaaaggggtgaacataataaatagaaaatttaaaaataagcattgaaataaatgtgatctgttaaccaaatgaaagaaaaatcaaaatgccatcattctgacacaagccaaaccataatagaggaggctaccagctgagcaacccagcaaaatagagagagcagttgatactctaatgtagtcttccactacaattgcaaattcttttaataactttcttgacaccaaaacatggtataggtatataattttgtttcataagtatgtggggttaaggatttgaattcgatcttttatccctaatctatatgtatttaaaaatatatgttaacaacccattaaatagatctcattatatcaagaaaataatcattattttttggtattcatactgttcacaaatattatttttaatttgtttttttataatttaactcataataattttcacattcaatccacaaatgcttattacaacaaaacaatatagatagaatttaatttttgaaatgaattgaaaaattcaacctgtatttcaagattttttttcattttaaggaatataaaaaaaatacatcatgtttttatcattattatgatatttcatattccaattcaattggatgctagaaaaaatgaatttgggatagtaaagaaaataaatattttaactactttttttaataaaaaaaataaactttcttgacgaagtttatgaaaaataataagcaattaataaattaaattgtttatccaaatatactaattgcttgtgtaggtggcttttctaacataaacaaggctcgaaggtcatacgctaaaggttggaatattggtctcttcaaaattttaaaaaacaaacaaagattgcacaattcacttttacattgaaatttaaagagaaatgttatttttagtatgacatcatttttttttttgcttaacagtattttatttctttattataattaatatgtatttttttacaaacagggttttttacttgaatttagtttttttaattaatacatttagatcttcggtcactttttctttacataaagttttcaagtccttgtttttatgcaaaacgttttaattttggacaaataagtttataagctattaaaataatttatagacaaattgaaatgtcttattagacccactctgaatattttttatttcataaaaaaataagaattaaacaaaaattgttctaaatataataagtacatttcttttcttttttttccttaacaaatgtcataataagaacaatcatttgcatttggaaaatgtaattaataaaaaaaaaaaaattaattggtaaaagaaaaggggatgaagttaattgataagatatgtattgtgaataaatgttattcgtttgaaattaataggaagaatgtatttgtttgatttgaaataaataagagtatatctgcaaattaaaaaaagtataggaagctttctcttttatatcagagcctggtttcgatccagggacctgtgggttatgggcccaccacgcttccgctgcgccactctgattttagaaattattaatatatattttattacttgtacaatattttgtgcagagtactgttttctttgtttgattgaagtttttgtgcaacgtcacatagcaatctactacggtcaccaattcaccaaaacaattgcaactttgacgcccacgattttttttgttcgaaatttattggatggcgtggttttccaaactttttagattttccgtctacttgccaaacttgtcacgacattgttgctaagaaaatatgttccttgcacgattagccaactgtgggagcagtattcggtaaacagataaagataattaacattactataagatataataatggtataaagggaatataccaaacttgaaccttcgaataaatctttaatattctatttaaaatttttaaaaaattaggctaaatagtaattttttatatgtgtagagtattcacaaatttatctccaaaaataaaaattcaaattttaatttttgaaaattaaaaagtgcaacaaattcatcaatcaattaactttcattcattattaatgaaaaagtttttgacacataggaacgaaaatatcataaaataattgtcaacatatatatttgactaaaatattagtaaatttttattggatcaaaatgtcattaaatttttattggactaatttatcagacattaaattttgtttcatttcagggcaaaatataattaaatctgcatcttctctcatttttttatcattgcaagcataataatacaataaatactttaaaaaaaaggaaaacaaacataaattagaacaaatataataataaatataatttatttgttgatttgaaatttttaatctgagaatactttgtcccaaatataagactcaaacaaaaatacatgtatcacacttttttttcacttttgagaactaaaatttaaatttgtatcttttgagaatgaatttatctatgttttacatattcagagaaaaaaatgagtatttaactaaaaaaaattatgttaaacaagtagtggtgttgagcattatttgtaatttatggaaatctagctgtagtttaaatataaaaattataactttattatttgcacactgataaaaaataattattgttatgaatatattgagattaagctactattttatcttacaaacattataaattcactagtatcgatgacttaattttggcatttatgttatatttggttgagatataaaaaataataatgtaggtcctatatagtttcataattcttagtctctatcttaatttaaattatattttttatctttatcgtctcaatcgaatatttaatctatttgaaaatataaatgaaacaaaataagtatgaagtaatccaaacactatttcggatagtctgcccccttttaaaaattccaacacgactagtaagaaagaaacacacatgtttggccagatattactaactcgaataaaatatatttcaccattattttcatagaaaaacaaacatttgagatcgaaagctaaccatgtggcaatgcgacatttaaatacggtatatatgatgcctgttgagagatcaaacaatttgttaattacgacagtcattgattacatcgacctttttttaattaaacaactctgctgtgtaattagcatcatttttatagtttaaacacgtgttggataattagcatcaattttcaaccatcttttttgtagtatcatatatgatcttttggggttgtagtattacattatttgaacaaatggacacctttcaattcaccaatcaccacctcacctatgattatcacagtcgtttttctcatctcatccgaaccaacaaaatatctgtcttttttatttttattataacttattttttcatacgtctgcaactgcgagaagtgatatttaacctcaaaattttaatatcttcgtatgtttacataattttatgttttattctaatagtatacaaatttgagtaaatatacactatttgcttaaagaatttttatataattaatcaatcataagttattatatattattaatttgtttttttgaatgcatgtactataaatttgttgattttaacaataattactttaaaatatacttattacatttctaatcaattaacactgtaaacctttttatactcacactgtacaaaaattgaacagaaaatttctatattattaattaattaaaaatattataaatatgagttttacagtaattataatattcaataaagttattatacacgtacgttaattaatatataaacggtagtataagaacttttatattattaatatattttaattaaatattaatattataacttataatattgaatgactgatccattttcctttcaggtgtcctcaattaaagttcagaaagtatgggagtcagttggattatgacgagttattaaaattaaacaaagtgagagcattgaaggaatttatgagttaatattcaatctcctggcatctctagatagatgttaaaagcaattttcttgttattttatggtgcatttgaaaaaggcaaaatgagaaaatatggaataatattgagcttcagccacaaatattatcagtttttatggcattgcaacacttttctgaatgcatggaagcatgcgtgaagaatcacaaaggacatcaacatgcatgaaaatgatgtcatcttgaaggagcataactattatggggttgttatttatctttgagataaacatggtcattttatcaaggtgaattctacttgttggcatcatggaattcctaaccctcgtggagcaaaagcatggcgtctcttacaaagcattgatacgatcaaaatagctaatgaatagtaggttcaaaatatataaaattgaaaagtataaaatatgaaaatataaaatataaaaataataattttaaatatataaaattaggagaataaaatataaaaatattagataattatatataattttttaaaataaagggtgcatttgcacatctcacaataatatacatttaatagtggatatggaagttcaaaatataccttttatatctaacaatcttttagattattaatattttcagattttcacacgttttatttaaatataaatcttatttattttaattttttggtgagttttttaaaagacaaactaataagttattcactagttaataagaacatataaattatatgctagtgtttatatctttgatcatatactcaattatatttattttcttattatgaataaaatggcatatctctctttctttttttaaaaaaatattacaacttaaatttaatagatatacacttttatatataggcaattaaaaattatcattttaagtatttgatataatttttcataaagaacttgaaattcagatttttagttaaaaaaataacatccccttggttaattaatcttgattagggtccctgatgaatgacaatgtaaaaatttactattagtaataatattttgtaaaaaaattatatttatttatttatttatttttataaattcaaaatttttattttattttataagaagattataacaaatcatacatttttattcaatcaactagttaaattcacctttaattttaattaagataaacacgaaaaaattccaataatttgtataccaaacaaaatagagggaggagcaaagtatgcatagttgactctcgaaaaacattcaaaagagtttcttctcctttcttcgatcgtgctcgtgccacggcgaagatgaagatagcgtggcttctgctgctcctcctcgtatcagtctgcgtaacgggctctcaagtttgggccctgaaatcgccgtttcacccgcgagacgtgcttcctctgctgcccagacaggtgtcgtggcccatcctcaaccgcctccacagagcggtggatctcctccccgtcttcgtcggcgccgcctcttcgccggacgacagtctcaagtggaaaggcgcctgcttctacgagaacaaagcctggatggtgtttcacaacaagagcggctctcaatatggcggtggaacccttcacatcaaggtcgcttccttctcaagtgtgggaatggaaatctatgtcacttctttttgttgaaaaaaaaatcaaattttatgataagcattcttgttgtaatgaacttttatttaatactaatcggtgaaggactaggtcaacttcgtttcatgaaatcttcattctgagtggttaacaaaaattggtcatactcttgaaatatttcgtagtttttttttttttactttaaaaaaattgcttagggagtaggtgtcattaagatttaaagagtgtttttttaatattggaatgcatagattatgttatgtggttgagttgtaatttggtggattttggttggacgtgttgtcatttgaaagcgtattacattattagaggagactaagttaagtggatttaatgtcgctcagtattttgtatgtcattagagtaatgaaactcttactcctcaaatagggtgtatggatggaaataagagagataaagagaataaataaatagagaggaactgatagatgtggcaaatgatgtgatggaaaatgaaaagagaaatatgaagaaaaatgggatagatcatagaagtgagatggaagaaaagttgggtgtatgtttagtattttcctattagtctatgcagttctataattgtattctttttatccctctctctctctctctatgtatggatttgggattcaacggaaactgattgataattatctatgtgctgatctaggttagcaatgctcacagttggacgtgcatggatctttatatttttgccaccccttatcgtgtaacatgggattattatttcctggcccgggagcatacgcttgagttcaaagagtgggaagggaaagctgagtatgagtatgtaagtgaccatctttcttctgtacactgtcactaagtagagttttttgaaacttgaaacacacatttttgttttggagatccttatcctctttgcaatcaggtaaaaaaccatgggttatcaattttcctcttgcaagctgggatgttggggacccttcaagcactttgggaggtcttccctctatttacaaatactggatggggggagaactccaatattaaatttttggagaagcatatgggagcttcttttgaagtgcgccctcagccttttgttacaaatgtcagtgctgatgacattcattctggagatttccttgccgtttcgaaaattcgaggtcggtggggtgcttttgagactctagagaagtgggttagtggagcttatgctggtcacactgctgtttgcctaagggactccaatgggaagctttgggttggagagtcaggacatgaaaatgaaaaggtaaaatatttaagttgcattatatctattggttctgtgcaagatttattatatttcatagcaccgttgtcagtatcatatgtttcacgatacaaaggcatacgattcgctttgagcagttggtgactcaattccttgagtgaaacattttgtgcttgaatcaccccatgaatagcaggaatcacataggaattgtagattgcacatgaatcatgtgattttggtgcaagcgaccgcacaccaaagtggttcgggttatgcaggacccagtttcgaactttgaagaaccctaaaattgtttttctttacctgaaaaattagtgaaaaagagagggaattggccaattctttccctctaatcaaccgcatggcagcccattgtctccttttcatgttttctactcattcttcttgtcttctactcttctttacctttcccaatctaccctacatgcaagctttgtggtccactcttatttagggtggtcatacactcatactgctgagtttgagcagctactggttttttgtccatatggctgttaagaattggtgattttttttttgttttgaagcttatgtccctttgtaagcaatttgacttcaaaatgctannnnnnnnnnnnnnnnnnnnnnnnnnnnnnnnnnnnnnnnnnnnnnnnnnnnnnnnnnnnnnnnnnnnnnnnnnnnnngttttttttaatgaatttgtgcttttatgtcttttttagttgtatatgttatgttttattattaatcatacagttcaatttgctatctggaaaataggccttccggttcacaatttgaatctcaatttcactaccatgtttcatagtcatttttttttataatttcattaatatttatattttcttccttaagaaaattaacatttcttgaatcctatgcgatgtttaggttttgatataatttatgaagaagtgttttaagttccttaagttaccatgtcgtcatcagaatagcaagattatgctctcagtttcagtttgaaattgtgataaaaaattagtgcatggtgattaccaagttaacatatatagattttcttttatgacataattcatgatggttgtttgattgtttgagcaatgatggtaaaagtatagtccatattggtttgtcaactccgcagcggcatttggagttaagttgctagcattttatttcctgcctcaccttttgtttgcagggagaagatataatagctgtgataccatgggaagagtggtgggactttgaactgaatgaagatgattccaatccccatattgctctgcttccattgcaccctgatttgcgtgccaggtttaatgagactgctgcatgggagtatgcactgagcatggcaggaaaaccatatggttaccataacatgatattcagttggatagacactttaaatggaaactatccaccccccttggatgctaatgtggtattaattcaatcagttgttctgcttaaatttcaattcatctgtttcattagattcaactatcttgagtttttgcactattatgccatgctttagcattttttacctacaattttctagcaattgtatgaaatatttcaaacagagaattatataaaccatggctttgatcttgcaagaactcaatgagctttctacttaagttgcttgaatagtataaagttttgcttgaattaccgtaccatatgctggtttatgtatagttatccgtctgccatccagaaagaccattgctattgaagaaaatgttatttcacataaaaaaaaagaagtgatgaatgtggtatcaattattgattgtttgttttctctatcttctgccctttctgtctttttttggtttagccacatgctacatagcttaatgttttatgaatgagcatttacttttgttgctctgcaggttgcttgcgttatgacaatttggagtcaacttcaacctgaatatgcagcaaatatgtggaatgaagccttgaacaaacgacttggaactaaagtatgctgcaatcttttttcttgctccaatacacacacacacacacacacttaaaaaaaggagaaataataattttatttcttgatcagaaaatgtattataattaatgctgaaatctcctaaatgtggaaactaggaatttaaataatacgcacagctacgcgaataattcacatgttacaaatgtataacaatgtcatcaatgtgagacaacaacactctcccacaagttggtgaatggatgtctacacatacaaacacacatacatatgtgatactaaacatttttgcttatgctagtaaattgaatcaatgtcttcaattgtctagcataagtcataagatgcttgtgatgtgatatattgcatagattagtaagcaatcagcaatatagaattccacattagtgaaaaaaagtgaaccatgtggcccttttgtgtttctacagggacttgaccttccagaagttttagtagaagttgaaaagcgtggatcatcttttgatgaactactgacgattcctgaacaagattattggacctacagtgatgggaagtcgacttcgtgcattgcttatatacttgagatgtacaaggaggctgggctatttgatccaatttctagttccgttcaagtgacagagtttacggtgagtttgctgggaagtttggtcttttgaattgcttgcaatattatagtaacttttgaatttcatcctacacaatttatacaaatgattgagcatatataatttcttatcatggttgtatagatttctaacaaaatcctttacaaagtgaaatcaggttgttgagcaggattgatatcagttcactacatatattgtttgtgtttctagaagtcaaaaacactttacagtagtatattgacctggcgcatatagacttatttttgtgcaataagtgcagataaaagatgcttacattctcaatttttttgagaacaattctagtcgcttgccaaaatggtgcaatgatggagacacggtgaagcttccttattgtcaaattaaaggcaagtatagaatggaattacctggatacaacaccatgcaaccataccctcatatgaatgaaaagtgtccatctcttcctccaaagtactccagaccccagaattgctagcagtcttcaattttttcctacaatcgaagggctgattgcgtgtgaccagattttttggtcttctagctttggatttcttaggagatgccaatgaattattgtttgtatccatttaatgtaaaaagaaattcaaacaattcgatatcgtgtatgtatttattattacaaacttgaacttatattagacattcatgtaattcggattatctatgtagccagattcaacagtgtaaatataagggacttgaatatatgtacatcatgcaaaattaactttaataagtgctatgtaaaatattttgtaagtcttgcatctgcattttttctctctctctaaaatgggtttggcagctttgaattgagaacttcaaaaactgtactgagttgtgaaagtagcaatttcgttgtttagtgtttactccaattcagcactctaatgtaagtgttacctgcttttaccatttaaagaacatagacatttgcagatagattaacgcagcgcaatacagatatatcacttttcaaatccggtataaccatgtaactcggaacattaaacaaaggtaagttttctaattttttatttgttttattttatggtcggtgcaagagaattaatcttgcatggccattcatgtgcactgttttgcacacatttccatctttttcatttcgcttcctcttctctttacttttttcatccccatttgatctcttgctcgacctcttgctttagcattaagatttttatactctaatctaatgtagtatgtttatgctctcaattacttctctttcttgctttatttttgctctctcacaacactattaatgtctatcattttatatatgtatcaacgtatatttaagttgtcgcagcgaaacatcttttagagttgtctaaattgaagaacccttaccaattatatgttttttcacttgaattgcttcaatattgtataatttttcctttgtatagggtttttaatggtcttagactcctagtgttctacttgaattttttcatgttttttttttaacattttgtaaagtattttatgaaactcataacagtacgagaaataatattcaaaatacaaattaatactttttaacatttcggaaagtactttcttatatgtttaaaacaaaatattattctagaaagtacattttggaataatggttatgtaacaatgttatgggtataaagggtatagttgataacaaacattaggtttaaatattttttcatccctataatttaacattttttttgccttcgctcttaaaatttttgtttcattttagttcttgcaattttatttttaattttcgttcttaaaatactttatatatcactttgaatagtaaaaaatatattttaaatagtaaaaaaagtgttatctaaaacactttgaggaagaaaaaaaacacattttgcaagaactggaatatattatttttttcaaagacaaaaatgaaaaaaaaatgctaaattgcaggaatttaaacctaaaaattaagaagaagagtgcctctctaaatatgaggtcctgggtgatcgcccactttgactgtatttagggccatcattacttaggcatgcatatttgaagtcaatggttataattgatatatatgtgtgtgtatataaagaaagctatagaagtgtcttgataattctagatttttctataaagctatagtagtcacatagataatagaaatgtctcgatagttcttaagttaggaaaatgctagaataatgtataatattatttaataatccacccacatatgtagtcagtgaagtgttgcctgtaaatatggaatctgcactctgttgtagtgtgcttttttgagagatcaacacaagctcctccactattgttaagagctacactgccaattattcactattacacttctatacaattcccttcactaagtcaattattactaacctctctaaagccaacgtcaacagccattaaacaatcaatccaattttcttattcctaaaatactaacagtactagtggttatgactgatgagttgatatgggtgagaccaattttgtaggagatggaacttgctaatacttgtcctatgaaactgcggggtgatcacaaccaagttgtcatttatatcatcacatcaaatctagtctttcacaaaagaacaaagcatattaaggtagattgtcccttcatctgagataaggtccaacataaatcttatatctacctcttaattatgtcaagacagatgaccaactagcatatgtatttgcaaaagcttttaatgaagtgcatagaaatttaatttgtgacgagttgggcatgaaaaacatttatactcccgtttgagtgggagtgctaagagtaaagttttagtctgtatacggtcttgacctatgtgcttgtatatacttaacctagtaatataaatattaggtaggagtagttattcattataaagtacccaattaaagtttactcatatacccctctatctctatctctctccctctttcacttctctctacaaaatagaaattaaagcttactcaatatcaggtcaatctgatacacatgaagacaacatacaccaaataaataaaactaaaataaaaatatctcagacaatggactgccatgtcttccaaactttggctggtgttatcagattgtgtttcgggagattgcatggaaagcaaaggctcatcatggagtgagaaatcgacctctcttacatcaacatcaccagatgttcagggatgtcatacttttgacaaacaatgggtctacaatgccatattatacatcatcaccatattatacaggctttatgaaagtcaaagaatatgaaacacatacaacaggaagcaatttaaggaagactaatcaaaattgtgctatatattttcgttcaaacacaaagatgaaacatcaactctgctgctacagaaatttccacaattattattaatcctaacttttcttgaacaatttcaaacatgactaactatgtattcaacaatttcaaacaatgtaaatgaacatatatcaatataaacaatcatgctaattttgattcagtgttgcactgcgtggaacctaatgtcgctgattgatgttgtgagggactgaatgatgcaaccaaattctggtggtcaatgcggtgagggacggggtcttgtaaggtaatgtcatgaatacttcttctttggcctctattatcggaggactgacgaagaaaatacttttgggcatggctagccacctgagtaggagttcttgtcttgacaacctttcttgaaatgtttatccaatctcccttttcatataactcaagtccgcggagaaacaacctacatattggtataaagatttaaatcatgagagaaaaacaatgaaacaacaatattaagaaagaagacactcagagagacacaaacagtacatgtgttcttcttgagtccatctcctgtactcacgggatttccgtggaggaggccgcgagtgatgattgatctgagagcttggaaattcaacctcggctggcaacaccggaatggagatgctgtgaagaaacggagtgagagtgttattcccttgatccgatggagacgtggatagagaatgaccctccgacgagacgagtgcctccctatgatgatcttgaagctcattgctgctgttccctcctaacatcgttctcttctaccagttccaattcaacttttctcctttctttctttctttctttctctttctttctttcttcacccactgatgcagatgcagagtatgtgtgtctctgttctgttgtttcctttatatagggtttggcattagcgcgcgccaaatcctctttcctcctctctctgtctaacggctactttcttatcaaatggcgccaatgccaagagaagcaaatcttcaccgttggctaattattaaataaataagctgttattaaataaaaacaatccatgtagacatattaagattaaatatatttttggcgttacatgggatacactcgagggtatttgctaaagtttaattttagtagaagggcatcaagtccagaacttttctagatttctcgagcttctacgatcgtgaagaacttgccaactagtctagaatcataacggagataattcctattgaatatgaggcacaactattcaccaaggctttaacagcatctccagcggcaattttaggtgggttgtttcttcttctttcttttttttttgacaggataggtgtgttcttgaagttaagaattgttcttaactgagttcaccattggacgaggatgaagtggatgcaatatgtgagaattattcgtatataagaatcagtctttttttttaacgaatataaacagaagtagcctttatcatccaaagctttgagcaacttatggaccaatttcctcaattcaaagttgaattggttattagacaagttaatgtagttgtccatttgcttgcaagggtaactactgttaatgttagttcccatgattataatcatattccttattttattcggtctttcatcatcaataatatgagctcattccgttttatgtataaaaaaaatcagttattaaccattaaaaataattaagagatgactaattagacccatttaaaaaaaatacaaaaagtgctaacttgtgagatctattttaacccacgttactattgaagatgttttataaataaaatttagcttggtactcaaagctataaatatatttttcctggatttgaaaacatatcaaaactatttttctcaaatttgaattgtggatataccgcaaagagctcatgtagtattttcatttttgagcaataactagcttattttacttcttaggacgctatccttaactcaaaaaaaaaaaaaaaaaaaaaaaannnnnnnnnnnnnnnnnnnnnnnnnnnnggaacttagaaagaatcaaaatcaaagcaacaatgaaaaacatggaaagatgaagaaaatgagaggaaattgggtaattcggtaggaagaaaggggtagagacactattttctttctttttattttttaaacttaggacttatttgataatcctttttctaattttgaaaataaataaatgtttgattatgtgttttttatcaataaaacttaacaacttttttatttaattcttattttgttttctaactttaaaatctgttttaaaacagcctcaccaaataaactttatctcccttctttttttcaaaacacaattttcaaaaatgattttacaaattatattttaaagaattttcatcacaagtttaatttcatggttagataagcacaacaagtattagctaatgcaataagcaaaaatttaattcctgggaggcacgcgttagaacctgatctagttgttgacaatgtaatttattccatatttaaagtagactcacaccaagaaatgtaaatttgttgaccagtcaaataaaaaggcttgataaatttcaattggaatttccatcgagtttgtcgagtatgcaacaaataagagccagttttgaatttaagcaacctcagtgataaggtgtgctaagctaagagaaaaaggaaagtagaaaataaaaagagctgcttagagagtgatgaagtactggcccaattctcctacgtgtataaagacaacgacaacacaacattgttccatactttgaaatcactaaagtacaatgatatatcttaaccatctaaggcatgcagatcaaccaacatatctgtattatagtaagcaaatatatgatatatcattatatcatcactcagccttggtggggagatggttgccgccagtcgctaatttgtagagataaaacagagtcatgagagcactgcaagaaaaagacagacaaatatcttaactccatatacaaactacaggtgactgatgtggagcaattggacaaactcacaaaacatagactaagtaatggctgccagtgcttgattcctgacttcaaattcagaacataatatatagatcttcaaatcaggaatgggaagttaaaaacaaattttagaactagcagaaaacaagttcaggataatggcacataaaaatatttcttttattctcaacataaatgggaatggtgaagccttgatcttttaaaaagagtttaaagaactttcatggatgcatttacttttaagaaagacaagttcaaggatttataatctacaaactaacaacttatccaacaattaaaacttaaaagtttaaatttagttcttacaactctgagagtaaaagtaaaactatgtttacaatgagtttgggtacttctaatcaatcctttgattacctgattccagcaacaagaccagcaggcataatcttggatgtttccaaatatcgctgccccatgacccaagttagtatggctgcacaagctgtttcacagtatacaaattagaaaaaaaaagcatagaaaattactccggctaatatggaccataattaactcagtgatcatggcttatcagattttatttttttttatccatagaaatcgaagacaatgtcagggagtttacaacaactcatgcacccttgctcaaccagagcaagacccccttaatatcatagcttatcaaatgaatacagagtaacagacatacattccccgtataaacacagagatactcattgatcctatatatattggtagtaatttagtataacttatgacttactaaaatattcttgcttaattttgagttttgacatatgataatgcaatgtgatacatctatacccctgctagagtttctgtgcatactttttattactaagtaggagcaatgcaagtcattaacttaatgataataaacttgttatattcataagcattttaaatcaaaaaaattctgtcaagaaattttactttcaatcgaataatatttgttacaaacacatccccctcctttgatcttttatatttatcattatattctaaaacatgggcttatattcaaagctaaagcaaaaagctctagttatagtcttgtaggacaaaccatgttccacttcatcaactatactaatgacaaaagtgtatggggcaagatccaagtctgataaataagcaatggaaatttgaaaagcatgcacccaatatatcttgatcaggttacatacattcattgatgcttccttggcattcaatattgtgcacagacaccctctttcagatctatgtatcactttccctccatcaggtagacaccctattaacctatcctaacctaacctaacaaatccccttccttttaatagaaagtagtaaatgaaaaagcaccatcattcaatatctttgaaacccaaagagcatttaggcagagtttcgataaacatttcaacaaacagctaacgcaaatccagagggtaaaataaaatagatcagacttctcccacaagttaaaacaacatatgcatcttaaagttttcataagtcgatacttgagctgcattattttaggagaacatggaattactaatctaaatatcaccatgacatcctaagagagagaatccaaatccagaatttcatacaatccgaaaaaatgaatccaataaatatccacatctttccatcaaataacaaattctagcatagaacacgtttcagatccagaatcatcgagagccaggtcaacaatcacacgcaaaataataataataataataataataataataataataataataataataataataataannnnnnnnnnnnnnnnnnnnnnnnnnnnnnnnnnaaaaaaaaaaaaatgaaccctcccaactgaacaacataatccaatcaaaatacgaaagaaatcaggtactgtgagttgatcaagtgggaaataaataacacaaagtgggtgatgatatagtactatatatttatgaatatgaacatgatgaatgaaaaagagtttgattgacctgttgagggtaagaggagtgggccttggaaattgaatcccatgggatggttaaggttttacgaggaagagatcgaacgtattcaggcgtggcaatagcaaaaagaagcgttagaatcagaagcagcagttgttgtttgagttccatgataacagtaacagtaactacctggctgagacaacaatgtacttccgcttcaatctttgtttctatcatcacccatcctcatgacatcaccaaatatgtcgttgcctcactttttccgctttgtttcgtagataaaacgaaaccacgctttcataattttcttaacaattaaaatatatttttagttttctatgagttttattcctttaaaatctgaaatcaatatttttttttgttttcattgttcatttaaatataaataaataatatttgttaatttaattaattttctcaatactaaaggaaaaaatgttaagaaaaacatgatactataccatacaaatatatttatttcagtttaatttaaacaaaatcactgaataacacaaataaaatgaggaaatacaacataaaaactgcagatgtattaaattaggattttagaatattagtttggtataataaaccttttggattttacaagactttggatgaatgtagtgaattttaagattttgtaaaaatatttttatgattaaaactttgtagtttgaattttaatagatttataacatattaatttataaaatttgagaagattttatagatttacaaagttttaataacttcactgaatttttagaaaacattataggttattagggtcaataaaaaaaatgttactgtttagataaaaaagagtgtaaccaatataaaattttccattatattaatagttaatttattctgtcttcccatttaatgtttcttcacataatttattaagcctatctgtgataaaatcttcttgtttatgcaattggatttgaaccaaaaatttaaatttatgatatttgttaattgataatactgaaaataaagaatcatatgttaattcaattgaaaattcattatcataatgacgttttttatgaagaaatttatgaatgtgtatatcatttttaacgaaaagaaaaatatattatgtgtgattaaataaaagaaaagcctgatcaacaataaaaaaagaaaaaaatattagaaaatctcaagagtttagtgtaataatttgttgagtgttatactaaaaaaaatcttataaaattatccaaatttatgctgaaaaattcataaaaaaactgtattttttttaatactatataaggcttttttataagttataaaaattattaatgaagattacaaacataaaaatgtccaaatccatcccaataaatcactatcaataacattacgaacaatctcctcactgttgagagtttcaaacttaatcatgtgggtgtgcgcataaattatccatgtgcacctatgctggacaaaggtagagtcttgtccttttaatatagtattgggtccattgactcaaattttatttccattatatttaactcaacattagaaaacccaattttctaatatacacaattctttgatgaattaaacaatattgctttgtatgtttaatatattttggtgaagtttgtctaactgtatatttggttaaagatatgaacttacattttagaaaaatacgaatttagttaatttgctaattatttactcaaattgtatgcttgtttaaagaggaagagagaaaaaataaaaagaaaaaatagaagcaatatttttttaaaaaaatgagaaaaagcataagacaaaatgattttaagatttttttttctttcaaaattccatgtctttcatttttcttcttcttaaattcaaaatttattttttctccctttattttacgagtttgttgcacaaccaattacttatatattttaaagataaattattataaattttatatatctctaatatatttttcaaatcataggatacattttacttaataatagattgtaattatatttaaaaataaaattattagagtatgagtatgagataaaattttaattattttgtgtctgatcaacatcaaaaaatttatactaatgaattattaacaattatataaatgaatttaatatcatatcttaatttaaaattttaaaactcacatttataagtatttttttcatttatataatatttaacttttttatatttattcgatgtgagacttctatctatacttatatttcaataaaattttataattaaattaaataacatataaataaataaaagaacaaataaaaaattaactatttatttatatttaaataaaaatattgattaaagtggaccattattcagcctattatttattagagagaggaactacgtcgtttaggaagggacattaatggttggtaaacacaaaaaccctaaaccctaccagcagctcagcgcgaaagccgtaaatcaatataacagttcgttctctcacactcttcacttttaagttcttctgcagacagcaagaagaagcataagcagaagaaccaaaactgaaaccaaaatcaaacgtttaagcttcgttttggtacgaaaccctagcaatggcgtcctccatagcgtcgcaattagaagctatcagatccttcgccaaaaccgactctgaccctctcaagaggccactcactcgcccttccatcttgtatgatcccaaaaaagcggctgacatctccaccgaggctattttcaccgaagctcttcgaggtcaatcttctcatttttaatttcgctcttttcaacatagctagtgcaactaaagcaatccagtaaaccgaattaatttctcagtgattaacatggagcatattcttagaatgtgggtttggacctaactcaaccctaccccaaaagctagctcatagggtgaggattatcccccacttatgtactctatcttgacactatctctacacaacgtcggacttgggtttttcttaatacatatgaattacggtgctactttatattctattttcgtttgattttgttctgtttttcttatgtgatgcaatatttcaggcttagagattcttattggcatggatgagcggttcaggaaccataagaacgatttgtttaaccacaggcgtatagagttggatagagagttgatgggaatagaacagaacaatcaacttaatgtctccattgcttcatacttgaaactactttctggatattttcttcatacggccgcccttcaaacgcttgagtacttgatacgtagacacaagtgagctttcaacaatgtattatgaattgttttcttcctaggggtgttgtgttgatgatcacatttcgcctctgcctagtttaccttttttgtgatttttgatgtggttgttttgagtttcaggattcacgtatacaacaatgaggatttgattttgtgtgctttgccgtaccacgacgagcctgaatttgttcgaatagtacagatacttgatacaaggttaggaagatattattatgtgtttttggtttggttgtgatgtagactactactggttggagaggcttctgatgtttctgttaatttatgtgaaggaatactaaatgggggtttcttgatggtgtgaaagcctctggtgcacggctgcctagaatggtcatagtgcagcagtgcatccgtgataagggcatattagacgctctatgcaactatgtgagtaattgttttgtgtttagttgtgaatgtggaagttctctagtggaatcaaataattatatggctaaggatttggttacaggcatctccgtcaaaaaagtctcgaccttcaatgcctgcaattnnnnnnnnnntaataataataataataataataataataataataataataataataataataataatgaaaggaaagaaattataggataccagtctcgaggaagagagcgaggtaagagttttttcgtttgccgaaggcattgagactgagatagccggcgatgatgagaagcaaaccggagccggcgcctccggcgagggaagcgatgctccctttgcttatgtaggcgaacagtccaccacctactaacatcaatccgtacggaatcgtgaagcagaaatcgtgcatttttctctccttagatgccttcaatcggaagaaagattggaactggtaagtggcgatgggagcttgtggaatgcacaagtcaaatattaacaccccacgaaaccctccacctgctccttaagaatcattcccacaatctaccgtctcatttttttaaacttttatgttagatttttttaaaagaaaattcattttataaaaggagtttttttttcattaaatcttaataaattacaatgacacctatttggtctaagggcatcactaatccaagatacctaagaaactcaatttcaatatcaggaaatatataaaatcatttatagtgatcccaaaatgtcatcatttttaagatactcacatgtaaattttctcaagaaaacttttttaggaaaataggttttaagaaaaacaaactaaatagagtagttttaaaattatttatatgttaccggttgtcacttaggataagttgttatccaaatggtactttgtgttaattttttattttgtagtatataagaggcatcgttttctaattttggttatacacttttttatatttacaacatttaaaaataaaataatcgattgtagatataattaataaaaaaaatatatattgatcgtcatgttatatagatagttttgaacataactctatttataatatataagtaattttttaaacctactttagcaaaaaaaaagttaaaaaattcacggtattatattttttaaatttttatttaattatgtttcaagttataacaaattatgacacttaaaagtctttaaatatgtttaaaatcttttaaataaattatcaaaagttattgatataagtgatactaaactcaatcctttttaaataaggtattcaatttgagacttgttaatgaataatatttgattgagaggaaaaaaatttaattaaagacaattggttaaatttttttgataaaagttaattattattaataaaattgataaatactaataaaaagataaaaaaatttatccaaacaattttttacaatttttaacaaaagaataataaaaaatatcacgtcatcacttacaatattaaactcttttggaaacaaagaaaggaccaaaatattaaaggaaaaaaagtctggaaaccaagatccaagacccgtttccgaaatattgaaagataaaattgaaaaaagtttaggaattaaaaatattgtttatcctttaaaattcataaaaaaaaaataaaaatccctattcaaaccgttttagggttttgtgtagcagcccaagctaataatggtggcttttcttggtacccgaatccagagcatcacctggttcaggttcaacccttcacacaaccacaagctccttccgcggagagccctggagatttcgatgtcgacaatgcaacagggccaatctaaaagacccatttgcccttcttgttccaaacccagccgaacgtgtctctgctctcgaatcgtcacaccgggtctccaaaattctgtgcatgtaaccattctacagcacgcgctagagcgtaagcatcccctcaattctaccagaatcgctatattgggcctcaagaatctcaccgttgcaactgtttctgatgttaatttcgaagcccggttcctgattcggttgttggatccgaattcccattcgggtcatgctggaaatgagccaactgcattgttttctcgtcagtgttgggaaattggagacacccagaaattgctttctgagaaagattctaacttgattgatactgatagtgctggaaaatctggtttgagaaatgatgttgaagatgttctggattctgcttctaatgcagaagttgtgatacaagtgagtatcagtgatggtgcagtggtgaacgatgaagttgagaaaaatgtaattagtccaaagtgtgatttagctagaggtgtacatgaagataatggagagctagctgttactgttaccattggcaaatatggtgccattagctctttgtctcatatttggatgactcaagcacaatttcaatcccccaagttaagctttgacaatattttggcgtaccctgaagcttgtgaagcactctcaaaagggtttttggtgaagaagtttcagaggaagcaactgaatagggatgaagaattggaagaatgtgaagaatttgagcttgaggttcgtcctggatcggtactactatttccctctgataaggctgttgatgttagtaacctggatgctataggttttgaggtgaagaacttgatagttctggatggtacatgggctaaggcaaaaagaatttatagtgaaaatccttggttgaacattttgccacacgtgaagttggaagtgaacgagacaagcttatatagtgatgtgaggcatcagcctaaagctggttatttgtccaccattgagagcattgtatttgccctgaaggcagttggggagttgaatcatgagggtttggatggtctcttggatacttttgagtccatggttggagatcagagacgctgtaaagaggagagactgagcaaacacttttcctgttgaggtcctttcttcttttgattgaacaactcgaagaagttgcttcaacccaaaatagaatctatttgcaataaattatgaaccatgaaccttgtaagagttttttttgcctccatatcctttccctgcatgcaaaacacaacatgggaatcccagtggattatctgtataatgatatggatggagaaccccactccaatgagtttattgaaacttagcagattattgctgtgccacatctgctgaacgaggacaggagcagtctgagataaagcaaccagttactggttgaaatatgctaagagggtgggaatttgtatcgatgttttagcacaattatatttttaagattggacaatgcactgaatgatgtctttaaaatcaagacaattttgatgtttgtagtgttactactgctacatgacctgacctacatgtttacactgaatggaagacattatgtggattgcatattgctagagtctctcctcaagaaagaaggggagagcatgttccccaaggacttttggacagaatcatggctgctcatgcttgctgatttcaacttcaagccaagagacgttgcaagcatcaagctggaccattaatgattacagaaacctcagcagaaactgacactgctaaagttacccattttctaaccacttgatgatgatgtgaaatagagaaacaaaacaacatggagaaacaaaacctaaaagagaggaggaaggggaaaaatgttacctgcctaaattcaacagatacagatatttgtttagaactcagtttgtattcacactttataaaatcactgtgatggcataaatgtaattagattctatttagcagatttcatgtgttgatgtatattggataaatcagtttcagtacttcaagacagaataggccaacccagtagtttccacttaatgcttaattatccactctgctgtttttaccgttctattcttagattgctgatttacattctatcatatcccatttccctggtatcagcgaacaatgatttcagatttaaggcattttgttaattagaccttcgtgcatcccagtaatcttcatggctttactcgttgcatgactctagaatcataatctaaaatctcaatgtcagtcaagaatataaaacatacatgtttatttctggttattaagtacgctaagttttagttttcctatatagaaatcagaaaccaatcttataagttcagacaaaacaagcaacaccatcaattgcaaagtgataactagccttatacctcagtttactcactctgctgctagtagtgatacaaactaaactaaggacttgtctaatcatcaatatttacataacttttgctaatccacgtagttctgagttttagggcgtcaaaagtatacttctgagttcatgtgtcttctgatcaacgcatcttgagctggccaaagaggttatccagatatcatcagcttttactggttcatcatcatcattcctatgccaactccagaaggcatgagtggagtttacaatcttcagctcaccatgaccaaaactggcttcacggaattctgaccactttggctgtgggtttatatacctgtcaacaaacaattatgtaaggatacatgcagcaacaatgacggaaaaacaaatttcaggctgcatacatgataaacctcaatatagcttttttttttttttttttttttttnnnnnnnnnnnnnnntgtttctggctgtgaaacttacttatgagctaagccttctctgtttcctccatcaccaatagttatatggacagcaccacagggatccaatcttccattatacacacgtttctgacaatgagatagagtattaaaacccagtttcaactaaatggtgcttacagagaaaataaaatgctaaaccataaagacatactgaacgttcataagcgtgaacatgaccagcgataactaaatcaacactggcagcataaagcaatggctccatagctgccatcatatcatcccctgcaccttgatgagccttgttactattataccatggcacatgaaataacacaagcagccaaggtgtccttttcctatctacctttgacagatcttcctgtagatgagggatgagtaaaaattaaagagtgaaaaaaaaagtggtccaaactccaaagtacttttctttttaaaatgatagagtagtgtaaaaaagacaaataaaaatagtaataacaagcatgattgtgtagttttccatggtcatgaattgcattacacttatccaatttttagtaactcttgatcaataggtgagatcaactaacctttagccatctgtattgttcagagtacacatcataatctgcataggagccaagcatgataacgtgaacacctgcaacttcaaatgaataatagagatttgaagttgatccactttcctcagatggcattttccatctggaattataggacacaaactcatccgttaagaatagtatgttctcctcttcatggtttccctctgtcaccatccacggccttgtactcgcaagcggctccacaagtttcccaaaattgtcccacagatgctgcatacaatcagcatatgaaaggtctcctggtagcaggtagacatcatatttacattggtctatgtgtgccagtgttgatttagtccaaccagtttgacctagatccccagccacagcaaaagtaattggaaattgagctggaggagttttgagctcaaactcgggaccttttccaccacatcggtagaagtacacagtattgtcttccaaagggccaattacggcatggtgtatctttcccgagctgtataacagatagttataagaagtgtactctccttcagctattgagtcatatctcccaggcaatgttccgtattctacatatgaaggtgaatgtttatcatcggttatccatgtaactctcatgtgcttgtctcctgccaaagaaatgtgtacctggaacaaaaatttggtatcaaagaaactgaaatttaatagtcaccataaaagaacatgcataaaagactaactaaagaggctgatatgattgcttaatagaggaagcacggttgacagttcacagaatatttgtcctagaattggcaaataattcatagaaagcgaaacaaactgttcaagttacataatattagctgataaataataatcattgtctgtacagatatatactataagaaatcaccaaccataacgaataaaaaatgtcttttgaagatttgtgactagaacccagatcatgaactataaatccaatacaagagtgacagaaaattattggatcaactttgaatttcataaccaaagaaaccgtgcagggctatatcttgaaccccggagacatgctcccatcgtcactgtcttaaaaatcatatcaaagacgatttctgaatgattaacaatatgattttttttattctacgtagaaattaaagtcaacaacttgaaatagagaataattttgaaaatatcaccctataaaaaaaaaaaaatgaaccctcccaactgaacaacataatccaatcaaaatacgaaagaaatcaggtactgtgagttgatcaagtgggaaataaataacacaaagtgggtgatgatatagtactatatatttatgaatatgaacatgatgaatgaaaaagagtttgattgacctgttgagggtaagaggagtgggccttggaaattgaatcccatgggatggttaaggttttacgaggaagagatcgaacgtattcaggcgtggcaatagcaaaaagaagcgttagaatcagaagcagcagttgttgtttgagttccatgataacagtaacagtaactacctggctgagacaacaatgtacttccgcttcaatctttgtttctatcatcacccatcctcatgacatcaccaaatatgtcgttgcctcactttttccgctttgtttcgtagataaaacgaaaccacgctttcataattttcttaacaattaaaatatatttttagttttctatgagttttattcctttaaaatctgaaatcaatatttttttttgttttcattgttcatttaaatataaataaataatatttgttaatttaattaattttctcaatactaaaggaaaaaatgttaagaaaaacatgatactataccatacaaatatatttatttcagtttaatttaaacaaaatcactgaataacacaaataaaatgaggaaatacaacataaaaactgcagatgtattaaattaggattttagaatattagtttggtataataaaccttttggattttacaagactttggatgaatgtagtgaattttaagattttgtaaaaatatttttatgattaaaactttgtagtttgaattttaatagatttataacatattaatttataaaatttgagaagattttatagatttacaaagttttaataacttcactgaatttttagaaaacattataggttattagggtcaataaaaaaaatgttactgtttagataaaaaagagtgtaaccaatataaaattttccattatattaatagttaatttattctgtcttcccatttaatgtttcttcacataatttattaagcctatctgtgataaaatcttcttgtttatgcaattggatttgaaccaaaaatttaaatttatgatatttgttaattgataatactgaaaataaagaatcatatgttaattcaattgaaaattcattatcataatgacgttttttatgaagaaatttatgaatgtgtatatcatttttaacgaaaagaaaaatatattatgtgtgattaaataaaagaaaagcctgatcaacaataaaaaaagaaaaaaatattagaaaatctcaagagtttagtgtaataatttgttgagtgttatactaaaaaaaatcttataaaattatccaaatttatgctgaaaaattcataaaaaaactgtattttttttaatactatataaggcttttttataagttataaaaattattaatgaagattacaaacataaaaatgtccaaatccatcccaataaatcactatcaataacattacgaacaatctcctcactgttgagagtttcaaacttaatcatgtgggtgtgcgcataaattatccatgtgcacctatgctggacaaaggtagagtcttgtccttttaatatagtattgggtccattgactcaaattttatttccattatatttaactcaacattagaaaacccaattttctaatatacacaattctttgatgaattaaacaatattgctttgtatgtttaatatattttggtgaagtttgtctaactgtatatttggttaaagatatgaacttacattttagaaaaatacgaatttagttaatttgctaattatttactcaaattgtatgcttgtttaaagaggaagagagaaaaaataaaaagaaaaaatagaagcaatatttttttaaaaaaatgagaaaaagcataagacaaaatgattttaagatttttttttctttcaaaattccatgtctttcatttttcttcttcttaaattcaaaatttattttttctccctttattttacgagtttgttgcacaaccaattacttatatattttaaagataaattattataaattttatatatctctaatatatttttcaaatcataggatacattttacttaataatagattgtaattatatttaaaaataaaattattagagtatgagtatgagataaaattttaattattttgtgtctgatcaacatcaaaaaatttatactaatgaattattaacaattatataaatgaatttaatatcatatcttaatttaaaattttaaaactcacatttataagtatttttttcatttatataatatttaacttttttatatttattcgatgtgagacttctatctatacttatatttcaataaaattttataattaaattaaataacatataaataaataaaagaacaaataaaaaattaactatttatttatatttaaataaaaatattgattaaagtggaccattattcagcctattatttattagagagaggaactacgtcgtttaggaagggacattaatggttggtaaacacaaaaaccctaaaccctaccagcagctcagcgcgaaagccgtaaatcaatataacagttcgttctctcacactcttcacttttaagttcttctgcagacagcaagaagaagcataagcagaagaaccaaaactgaaaccaaaatcaaacgtttaagcttcgttttggtacgaaaccctagcaatggcgtcctccatagcgtcgcaattagaagctatcagatccttcgccaaaaccgactctgaccctctcaagaggccactcactcgcccttccatcttgtatgatcccaaaaaagcggctgacatctccaccgaggctattttcaccgaagctcttcgaggtcaatcttctcatttttaatttcgctcttttcaacatagctagtgcaactaaagcaatccagtaaaccgaattaatttctcagtgattaacatggagcatattcttagaatgtgggtttggacctaactcaaccctaccccaaaagctagctcatagggtgaggattatcccccacttatgtactctatcttgacactatctctacacaacgtcggacttgggtttttcttaatacatatgaattacggtgctactttatattctattttcgtttgattttgttctgtttttcttatgtgatgcaatatttcaggcttagagattcttattggcatggatgagcggttcaggaaccataagaacgatttgtttaaccacaggcgtatagagttggatagagagttgatgggaatagaacagaacaatcaacttaatgtctccattgcttcatacttgaaactactttctggatattttcttcatacggccgcccttcaaacgcttgagtacttgatacgtagacacaagtgagctttcaacaatgtattatgaattgttttcttcctaggggtgttgtgttgatgatcacatttcgcctctgcctagtttaccttttttgtgatttttgatgtggttgttttgagtttcaggattcacgtatacaacaatgaggatttgattttgtgtgctttgccgtaccacgacgagcctgaatttgttcgaatagtacagatacttgatacaaggttaggaagatattattatgtgtttttggtttggttgtgatgtagactactactggttggagaggcttctgatgtttctgttaatttatgtgaaggaatactaaatgggggtttcttgatggtgtgaaagcctctggtgcacggctgcctagaatggtcatagtgcagcagtgcatccgtgataagggcatattagacgctctatgcaactatgtgagtaattgttttgtgtttagttgtgaatgtggaagttctctagtggaatcaaataattatatggctaaggatttggttacaggcatctccgtcaaaaaagtctcgaccttcaatgcctgcaattnnnnnnnnnnataataataataataataataataataataataataataataataataataataataatgaaaggaaagaaattataggataccagtctcgaggaagagagcgaggtaagagttttttcgtttgccgaaggcattgagactgagatagccggcgatgatgagaagcaaaccggagccggcgcctccggcgagggaagcgatgctccctttgcttatgtaggcgaacagtccaccacctactaacatcaatccgtacggaatcgtgaagcagaaatcgtgcatttttctctccttagatgccttcaatcggaagaaagattggaactggtaagtggcgatgggagcttgtggaatgcacaagtcaaatattaacaccccacgaaaccctccacctgctccttaagaatcattcccacaatctaccgtctcatttttttaaacttttatgttagatttttttaaaagaaaattcattttataaaaggagtttttttttcattaaatcttaataaattacaatgacacctatttggtctaagggcatcactaatccaagatacctaagaaactcaatttcaatatcaggaaatatataaaatcatttatagtgatcccaaaatgtcatcatttttaagatactcacatgtaaattttctcaagaaaacttttttaggaaaataggttttaagaaaaacaaactaaatagagtagttttaaaattatttatatgttaccggttgtcacttaggataagttgttatccaaatggtactttgtgttaattttttattttgtagtatataagaggcatcgttttctaattttggttatacacttttttatatttacaacatttaaaaataaaataatcgattgtagatataattaataaaaaaaatatatattgatcgtcatgttatatagatagttttgaacataactctatttataatatataagtaattttttaaacctactttagcaaaaaaaaagttaaaaaattcacggtattatattttttaaatttttatttaattatgtttcaagttataacaaattatgacacttaaaagtctttaaatatgtttaaaatcttttaaataaattatcaaaagttattgatataagtgatactaaactcaatcctttttaaataaggtattcaatttgagacttgttaatgaataatatttgattgagaggaaaaaaatttaattaaagacaattggttaaatttttttgataaaagttaattattattaataaaattgataaatactaataaaaagataaaaaaatttatccaaacaattttttacaatttttaacaaaagaataataaaaaatatcacgtcatcacttacaatattaaactcttttggaaacaaagaaaggaccaaaatattaaaggaaaaaaagtctggaaaccaagatccaagacccgtttccgaaatattgaaagataaaattgaaaaaagtttaggaattaaaaatattgtttatcctttaaaattcataaaaaaaaaataaaaatccctattcaaaccgttttagggttttgtgtagcagcccaagctaataatggtggcttttcttggtacccgaatccagagcatcacctggttcaggttcaacccttcacacaaccacaagctccttccgcggagagccctggagatttcgatgtcgacaatgcaacagggccaatctaaaagacccatttgcccttcttgttccaaacccagccgaacgtgtctctgctctcgaatcgtcacaccgggtctccaaaattctgtgcatgtaaccattctacagcacgcgctagagcgtaagcatcccctcaattctaccagaatcgctatattgggcctcaagaatctcaccgttgcaactgtttctgatgttaatttcgaagcccggttcctgattcggttgttggatccgaattcccattcgggtcatgctggaaatgagccaactgcattgttttctcgtcagtgttgggaaattggagacacccagaaattgctttctgagaaagattctaacttgattgatactgatagtgctggaaaatctggtttgagaaatgatgttgaagatgttctggattctgcttctaatgcagaagttgtgatacaagtgagtatcagtgatggtgcagtggtgaacgatgaagttgagaaaaatgtaattagtccaaagtgtgatttagctagaggtgtacatgaagataatggagagctagctgttactgttaccattggcaaatatggtgccattagctctttgtctcatatttggatgactcaagcacaatttcaatcccccaagttaagctttgacaatattttggcgtaccctgaagcttgtgaagcactctcaaaagggtttttggtgaagaagtttcagaggaagcaactgaatagggatgaagaattggaagaatgtgaagaatttgagcttgaggttcgtcctggatcggtactactatttccctctgataaggctgttgatgttagtaacctggatgctataggttttgaggtgaagaacttgatagttctggatggtacatgggctaaggcaaaaagaatttatagtgaaaatccttggttgaacattttgccacacgtgaagttggaagtgaacgagacaagcttatatagtgatgtgaggcatcagcctaaagctggttatttgtccaccattgagagcattgtatttgccctgaaggcagttggggagttgaatcatgagggtttggatggtctcttggatacttttgagtccatggttggagatcagagacgctgtaaagaggagagactgagcaaacacttttcctgttgaggtcctttcttcttttgattgaacaactcgaagaagttgcttcaacccaaaatagaatctatttgcaataaattatgaaccatgaaccttgtaagagttttttttgcctccatatcctttccctgcatgcaaaacacaacatgggaatcccagtggattatctgtataatgatatggatggagaaccccactccaatgagtttattgaaacttagcagattattgctgtgccacatctgctgaacgaggacaggagcagtctgagataaagcaaccagttactggttgaaatatgctaagagggtgggaatttgtatcgatgttttagcacaattatatttttaagattggacaatgcactgaatgatgtctttaaaatcaagacaattttgatgtttgtagtgttactactgctacatgacctgacctacatgtttacactgaatggaagacattatgtggattgcatattgctagagtctctcctcaagaaagaaggggagagcatgttccccaaggacttttggacagaatcatggctgctcatgcttgctgatttcaacttcaagccaagagacgttgcaagcatcaagctggaccattaatgattacagaaacctcagcagaaactgacactgctaaagttacccattttctaaccacttgatgatgatgtgaaatagagaaacaaaacaacatggagaaacaaaacctaaaagagaggaggaaggggaaaaatgttacctgcctaaattcaacagatacagatatttgtttagaactcagtttgtattcacactttataaaatcactgtgatggcataaatgtaattagattctatttagcagatttcatgtgttgatgtatattggataaatcagtttcagtacttcaagacagaataggccaacccagtagtttccacttaatgcttaattatccactctgctgtttttaccgttctattcttagattgctgatttacattctatcatatcccatttccctggtatcagcgaacaatgatttcagatttaaggcattttgttaattagaccttcgtgcatcccagtaatcttcatggctttactcgttgcatgactctagaatcataatctaaaatctcaatgtcagtcaagaatataaaacatacatgtttatttctggttattaagtacgctaagttttagttttcctatatagaaatcagaaaccaatcttataagttcagacaaaacaagcaacaccatcaattgcaaagtgataactagccttatacctcagtttactcactctgctgctagtagtgatacaaactaaactaaggacttgtctaatcatcaatatttacataacttttgctaatccacgtagttctgagttttagggcgtcaaaagtatacttctgagttcatgtgtcttctgatcaacgcatcttgagctggccaaagaggttatccagatatcatcagcttttactggttcatcatcatcattcctatgccaactccagaaggcatgagtggagtttacaatcttcagcnnnnnnnnnnaaaaaaaaaaaaatgaaccctcccaactgaacaacataatccaatcaaaatacgaaagaaatcaggtactgtgagttgatcaagtgggaaataaataacacaaagtgggtgatgatatagtactatatatttatgaatatgaacatgatgaatgaaaaagagtttgattgacctgttgagggtaagaggagtgggccttggaaattgaatcccatgggatggttaaggttttacgaggaagagatcgaacgtattcaggcgtggcaatagcaaaaagaagcgttagaatcagaagcagcagttgttgtttgagttccatgataacagtaacagtaactacctggctgagacaacaatgtacttccgcttcaatctttgtttctatcatcacccatcctcatgacatcaccaaatatgtcgttgcctcactttttccgctttgtttcgtagataaaacgaaaccacgctttcataattttcttaacaattaaaatatatttttagttttctatgagttttattcctttaaaatctgaaatcaatatttttttttgttttcattgttcatttaaatataaataaataatatttgttaatttaattaattttctcaatactaaaggaaaaaatgttaagaaaaacatgatactataccatacaaatatatttatttcagtttaatttaaacaaaatcactgaataacacaaataaaatgaggaaatacaacataaaaactgcagatgtattaaattaggattttagaatattagtttggtataataaaccttttggattttacaagactttggatgaatgtagtgaattttaagattttgtaaaaatatttttatgattaaaactttgtagtttgaattttaatagatttataacatattaatttataaaatttgagaagattttatagatttacaaagttttaataacttcactgaatttttagaaaacattataggttattagggtcaataaaaaaaatgttactgtttagataaaaaagagtgtaaccaatataaaattttccattatattaatagttaatttattctgtcttcccatttaatgtttcttcacataatttattaagcctatctgtgataaaatcttcttgtttatgcaattggatttgaaccaaaaatttaaatttatgatatttgttaattgataatactgaaaataaagaatcatatgttaattcaattgaaaattcattatcataatgacgttttttatgaagaaatttatgaatgtgtatatcatttttaacgaaaagaaaaatatattatgtgtgattaaataaaagaaaagcctgatcaacaataaaaaaagaaaaaaatattagaaaatctcaagagtttagtgtaataatttgttgagtgttatactaaaaaaaatcttataaaattatccaaatttatgctgaaaaattcataaaaaaactgtattttttttaatactatataaggcttttttataagttataaaaattattaatgaagattacaaacataaaaatgtccaaatccatcccaataaatcactatcaataacattacgaacaatctcctcactgttgagagtttcaaacttaatcatgtgggtgtgcgcataaattatccatgtgcacctatgctggacaaaggtagagtcttgtccttttaatatagtattgggtccattgactcaaattttatttccattatatttaactcaacattagaaaacccaattttctaatatacacaattctttgatgaattaaacaatattgctttgtatgtttaatatattttggtgaagtttgtctaactgtatatttggttaaagatatgaacttacattttagaaaaatacgaatttagttaatttgctaattatttactcaaattgtatgcttgtttaaagaggaagagagaaaaaataaaaagaaaaaatagaagcaatatttttttaaaaaaatgagaaaaagcataagacaaaatgattttaagatttttttttctttcaaaattccatgtctttcatttttcttcttcttaaattcaaaatttattttttctccctttattttacgagtttgttgcacaaccaattacttatatattttaaagataaattattataaattttatatatctctaatatatttttcaaatcataggatacattttacttaataatagattgtaattatatttaaaaataaaattattagagtatgagtatgagataaaattttaattattttgtgtctgatcaacatcaaaaaatttatactaatgaattattaacaattatataaatgaatttaatatcatatcttaatttaaaattttaaaactcacatttataagtatttttttcatttatataatatttaacttttttatatttattcgatgtgagacttctatctatacttatatttcaataaaattttataattaaattaaataacatataaataaataaaagaacaaataaaaaattaactatttatttatatttaaataaaaatattgattaaagtggaccattattcagcctattatttattagagagaggaactacgtcgtttaggaagggacattaatggttggtaaacacaaaaaccctaaaccctaccagcagctcagcgcgaaagccgtaaatcaatataacagttcgttctctcacactcttcacttttaagttcttctgcagacagcaagaagaagcataagcagaagaaccaaaactgaaaccaaaatcaaacgtttaagcttcgttttggtacgaaaccctagcaatggcgtcctccatagcgtcgcaattagaagctatcagatccttcgccaaaaccgactctgaccctctcaagaggccactcactcgcccttccatcttgtatgatcccaaaaaagcggctgacatctccaccgaggctattttcaccgaagctcttcgaggtcaatcttctcatttttaatttcgctcttttcaacatagctagtgcaactaaagcaatccagtaaaccgaattaatttctcagtgattaacatggagcatattcttagaatgtgggtttggacctaactcaaccctaccccaaaagctagctcatagggtgaggattatcccccacttatgtactctatcttgacactatctctacacaacgtcggacttgggtttttcttaatacatatgaattacggtgctactttatattctattttcgtttgattttgttctgtttttcttatgtgatgcaatatttcaggcttagagattcttattggcatggatgagcggttcaggaaccataagaacgatttgtttaaccacaggcgtatagagttggatagagagttgatgggaatagaacagaacaatcaacttaatgtctccattgcttcatacttgaaactactttctggatattttcttcatacggccgcccttcaaacgcttgagtacttgatacgtagacacaagtgagctttcaacaatgtattatgaattgttttcttcctaggggtgttgtgttgatgatcacatttcgcctctgcctagtttaccttttttgtgatttttgatgtggttgttttgagtttcaggattcacgtatacaacaatgaggatttgattttgtgtgctttgccgtaccacgacgagcctgaatttgttcgaatagtacagatacttgatacaaggttaggaagatattattatgtgtttttggtttggttgtgatgtagactactactggttggagaggcttctgatgtttctgttaatttatgtgaaggaatactaaatgggggtttcttgatggtgtgaaagcctctggtgcacggctgcctagaatggtcatagtgcagcagtgcatccgtgataagggcatattagacgctctatgcaactatgtgagtaattgttttgtgtttagttgtgaatgtggaagttctctagtggaatcaaataattatatggctaaggatttggttacaggcatctccgtcaaaaaagtctcgaccttcaatgcctgcaattcgcttttgtactgctgttttcgttgaagttttgggtactgttgtgactgttgatgatgatcttgtaaagaggatacttccctttgtgagtcttcagcctggcattaagggggtttcagatcacaaggttagcttcctaggaaattattttccatgtattaaattttaaaactgattatagttgggtatcatactgtcatatttttgtgattaccttctcattagtaggcaatgtaattgctatcaaatggtagactgcgaaataaatttgctcttttgctctacaatatccaccagtgtaatattattcatcacagataggaatagtagtgcataattttttatgttagtatagtcataaaatatgattatatgactgggtgaccttacttttagtgcttatttgatctgttgaaattatggggttttaggtatagagggagttaaagaagagaatagaagctttgaatgatattctactgattatttgaccttactttttatgttggttgtggtgcaaaaatttggagaaaggctttcacatgcctttccacgtttgggcttgcaaccttagggatattttttgtaagcaggggagagtttaatctctctcacctgtctggggggttttaggtccatcctgtttatggcacctttattcatgttttctatgtattagtgtgccataggctgggttttgttatcatggactgttttctgctttctttttgtatctatccttttttctcatatatataatatatacttttgctgatcaaaaaaaaaaaaaaaactgattattacgatgaattgccatgtcttggatggtatattcatgaaatccgaagtactaacccttatttatattaatcatagagcaatcctgagagataatggaagtataggaagactaatcctaaaacataatctaagatactctaacatatgataaaatattttcacatattccaacaatatatgtatacttgtgtatttgagctatgtttcttggctccctctcctgcatttttttgttgtcaaattgtccttatttacaattagcagctggaagctcactttcttgtgctttcttttttggttttctatttgcaggctggttctcttatgatcattggtttgcttggaaacaaaactgcattagctcctaaacttttgaatagtttgatacgtttggttgccgagattgctcgtcaggaggctacagagttgacagatctccattggtttcggttgtcccttattaccttaattagtcttgttcaggtactagtgtaatccnttttttttttttttggggggggggggtgtaattggtatttcatccaatttcctttcattgtgcaatatctatttctgaatggctatatttttattttaatttgttctgttggaattttcttagtctcaaaatgttgaaatactcccattgaaggccttggagatattaaaggaaataaggtagtcttcctcgaacttctcatcatatgcataatcactgtgctttgactgttgccttttctttatttatatttatgatttattaaatcccttttcatatagggacctggcaggggttttattagaattatctaaggagttcaatatcgaaaagtttctcctcgtgcttttggactccctgattgactgcaggtgtgtttcctatgattgtctttcaggagatatatgctttaagtcatatcttatagaagcttgtgttttatgctgattataacaataacacatttgcagttcttctgatgaatactgtcagcggactttgctatccttaatagaaaaagtccccgtacatggtcttgtttatcatgtggtcaccaagatcctttcaaattgtgtgaaattatcacaaaaagttagcgactcaacttcttccatgtcaggtgtgtaatctgattttgaattttagaatgctgatcactatcctgtaccccaaattatatatcctggtgtgcttcataaggttgatctaataattcataccaagagtgaatcaataaatttctaaagaaaataatatttaatgaaaatctcatttggtgattgagaaatctcatctaaacttctgtaaaaaaattgtttgaatacctgtgtgaaaatgttcttctgaattctgaaagcaatgaccatggatgcattttaagttacttggaaatttctttcaccatgaagatcttactttgtgtttgtataagcttattttggaggcgaagaaatttttttggcagcttatctggaaattatttcccccgacacagaacttttcaaacatgcaatagatacatgatattaaaagtggtctacttagcagttaatttgttttctatatcaatattatgtaagtaataaaatgtttgtccagactgtataaatagtaagaactggtgtttgaaacaccagaacaaaagcattgcattataccgaatgctgtcatcactccatttctacagtatgaaaagcatttctcaattaagagccaaactcttggattacgctggttacaatgccttgttttcaaagaatcttactccattctttaacagtttaaccctgtgttgaaactgataaaagaaaattggaatttgatgttgaagtctaatgtgtgccttcaggaagggaagttttatttgttaagaaactacatactcttttttttcaactgtaaataaatagattaataaagaaacccagagaccatgaaagatacttatgaagacaggaaattgcacatactactgtcctatacattaatgctgctaacaatccttgttgataccaactctgttttggccaagtttgagtgtgaaactgctttaaagcagttgaatatgtgatttaaaacaaatttggtgtgttgtaaacaaaccctctaatgaactagatatcttcaaattgtgtatctcactatatggcttaagatttgtctatgtgtatcatgcatgcatgttatgtcttcattagtcagtgtactttgttttacttgcttcagcttggaaattcaaatttcttttgaagaagtttcgttgatttctgtgtaaattattattgtcaggttttgctcctgaataattttgttttcttttcttatggtgttttttttttttaatcatttagctccatatggtttacctttatcttttttactagaaatctacaactagtcagttatcatttgttgcctagcttattattctcataatgttggtttgccaaatgttgattagttgggtgggcaaaaaagattctgtttgttgtcaatacaaaatacccttctgaattacgaggtgctgctcatcatttccttcaggtatgctgatgagttgtctgcttttttgttgttgtcatgcattgtcagatagtatataatggcttgaactttgaacatgttcaacaggataataaaggacattctaagaaagatgattcattgtataaggttttatgtaagatgttggatgggagtatggattcgtcacttggtatttcagactcaaatatttggttgggcctgtatcatccaaaggtatcaatcattgacctattcttgattattaggtgtatgtaaatataaaagtatgtattctcctgttcaacaatgataatttttttataattgtaagagcttcatgatttatatttgatatggtggtctaggctgatgttcgacgtgctacgctgcttgatttaaataattccgttatcctgaaaaccaaggcagttggttcagaggtatatatgctccgttaatcttctcgtcctcccaaaacctcatgtttccattaatttgtatttttttttttatgacaatgtttgaagaacatctttgatgtgctccttttggttggaaaaaagttgaaacttcttgcttgatgtggtttatttcctttatatatctgtcctcccaaaactgcatgtttgaaatttgtatttttcatttatgacactggttgaagaacagccttgatgtttctctttttgggtggcagaactattaaaattttgcttgatgtgttttctgttttgcacacacacataatgagggattgttttctgatgttgaccttgagttttattatttgtagtttgggcttggacccatgaatagctactgtgcttagggaccctaaacctatatatttccttgtaatctgagtacattgtaacgagtgtgtgaggaaaatatagagaatagttagacgtagcccacattgggtgaaccagggtaaacactatgtgttattttcttcttccttttcttctctttccgctctctcgattgttgtgtgattgcttggtaccaacacttacatcattcagtaactttttactggataaatttatctcgttacccattgttggattaaaagttcctatcatatctacagaattttagattaattcaatttttttatacatcattcagttcttcaaaattaatgttatatatacttctgacatataaaatcaaacccattcgattttcttcttattgttgttcatattttagaagatttgacatagataattttggtaatatataattataattcaatagttggcaaaaattacatttcataatgatgtaagagtaagtgtgatttacaacggtgtaaattaattcctctttaagtgtgtgtaatttctgatggtggtggcatattacttctctttgattttttatttttatttttaggaaatggttgcattacaaaattttgctgtcaaactagttttatttggaaatattttttgatacatttaagttccattttgaatgatttgaactgagatgcatttgtgatctaatttgtcaaggccactgattttacacattgttggtgagggagggtataattgatttttgttagaaaacttcatttgaaagagtaggtgtacaaggagggaggagtatatatccctcaaaagccacctcaacttcatttgaaccgagccaggtaataaaggcttagcaaaaagtgaagaccacagaactcaatattaaacctgatatctttacaacactgtcaaaatgcaacagtgaaacccctctgtaaactgagccttgaaccacgatgaactcaagggcacaaatctgtccaaaagaaagtgtggtggtggaaaatgctataaaaatttattgcatcatgtttcattgtcaaacacaaacaccaattgctagtaagaagtactcagtaccaatggtaccattatttagtacttggtatgctataattaattatatttataagccataaattaattgattatcacgtgggttatgctgtttttatgtgaaattatgggttgatttcatgttgacttagggaaatctttataatatggtcaaagttcttgctaggatgtgttaatactgttttgccatattcaaagtcttcaacctttaactaaccccaaaagtcatcttttttatcagaatcttgtaagcatccaagaggacatcttaagacagcttgatgataaagatctaacagttgttcaagcagctttacgtgttgatgacttgcgaaatgtaatagattcttctaagcttcttgatgcactacagaatgtgctaaaaagatgcactggcaaactgctgtcaggtaatttgtggtatattaaaaataattagatagatatcatctttattgtttctgcatgttgtattgaagcaatacataccatgcatcgatttatccataaacttggacaaggaatttgttctttgaatgcattcttgatggatgatgattgatgactgttaggggatggtggggttacgtgcagaatacagatgtggtctcataaatgtctaagcttccttaatgtgtttccaatggttcaaaatatgcttatgcttattcttctgtgtattttgggattgatttactctgttgaacttatattatttcccttttctttttgaagagtgtctggttgtccatttttatgtttattttatcaaaatatgcttttactttatgttgactagatacatataagcatataaccttcatttcatacacttattccagttgtgcttctgttactggagtatatttgtcctcattaagttatggctagttgtttcctgtctttgacaagtaaacttatttcagttctgttgtaaccatggataaggatgaatttggcttcccagagatgtttgtatttagatattctttaaacaaatggtctttgcttggttccttactaatgattcattcaacgatgatgcatctatcccaagattgggtgggaggattacataactgaataaaaaaaattatgctcttagttcactgcatgtattatgcacccattctcttcttgtaggttcagctgataactatagtctaaatgttgaagttgctgtcacttgtctaaagaatgccatctcctacttcagtgatcatgctgattacttgaagaatgttgctgctatgatttttccattactccttgttctaccacaggtagtggttaacatcatatttaatatttgtttttcggatagaaaattaatatattttgatcttgtacttatttaatagcttttagattttcccgtctctgggtaattatcaaataaccacttattttgccatgcgcagacacagagcttgaatttaaaggctttgggacttgtcaacaaaataaactggccactttatcagaatattgttgtatcttcttttggagaaggggtaaatatctactttggaattagtttgctataaatttaacgtacacttacaatatgaagaaatttaattatgttgctcaacaaggcaaatttgtcaaactcaagatcctataaagaattttccaaggtgaactgaagatatgaatcaagcattaggtcctgtctcctttggaaaaccaaaactttgaaatttgaaatgcacattttttacagatattatatagggaataacccaattgcaccatgaatagtacatgaacatgatatgttactacttactagtagtacttgtagtgtgggttttctaaaaagatatttttggtttcatcatatttctaagttgttaatcagtaatcacaacaattcatgaatatgtttatgtcagatgaaattgtcaatcatcttttactttagtgactcttgaagtaaaatcgcagacattgatacctggaagtttatcttcaattaacttgaagactattgataacatggctaagaatttcatggtccatcccaaagagcatatagcttggtttgttgaaagctgcagtgatttggagttgtcaaagacactcttcttttttgttcttttgcagtctcttttgataaaaccaaaaggtttgttttccccttctctttttgaattccattttaatatttttcagaaatagttaataatcttatatcgtataatgactaaaaacaagtaatgtttgaacaaataagctagaaataaatgtttgaagcatatcttatacatcccctagttgtacttttgtcttctctattagatttcttagccaaaaaatttcaagaggggactaaggaatgataaatattgactttttccttttgatcaaagatgaagacatttgtgcactatttgaatgtgtatttcctattctaaaggctgagtgggaaacgtcagtgacagctggtgatgtctcattggatgaggtacaaaggatttactagcatatttgtgcttttatttcattatttgtttactttttttgtaatgagaagctaatgttttacttctgttttgattgttgggaattcgggttgttttgcagttcaagtctgaagtgttagactgggattgcagtgcattctttaatgatcttttgtatgtcaagctgagccatcttaatgtgaagcttatgatttgcatattttggaggctagcacaactaatatcagtactaacttctgacattctgcttgtaagtaattcctttactatttgtaatcctgttatctattgtcttatgaacttgctttccttcttggaatttgttgttgttagactctcaccgtcaacattggttggatattaacctttttcaaaatgcagcatgacgatgataagtgggtcagcaagataagggatctgtttgtattttttgcttcatccaaattgaagcaagcattccatgaacacctccattacttagcagcgcagtgcagaatatcacctccccgcctcttatctaagtttttcacagaggaaggtgctatacacttattccttttgtttgatttttcccatattttacttggccaatgttgtgttccttctactgtgaaattactgcctgtgttatggtgtagaaaatgagaaagaaaattttctgaatgtacttgattgtattttctacccagtagagtgaactgtttatattcaacaatattgcaaagataatcaatgccgaaacaatttaacaagagaacaatttagatgccactacttcctaagatgcattgatcctgactataccaagtatctaggatacttggaaaaataatcattaaaggagctctattctcctaaaatgttcgtatttccaagggagagaatagaactattttttctgtaattatcatgatctctcatgcataataatgaatacacgcagacacacatatttgctgtttagaaggtacaaaatttatatttgtagttattctctttctatttccattctttctccttttcctattctttttactccattttcaattattttgtatatccctgataaatccttccatcccccgttaggggcattttcatcctgaccaatccatgtttaggtgttaaagtggctgttttgtgttaggctttctgtatcctacgtgtttgacttgtattcagtcagaagtaagctgccagttgttagttagagacagttatgggttcactctattgtaacagattcagaggtgatacacttttgaatatagtttgatttcagatctagaacaatctttttctctcaaatctctcttgccaactttctctttggttcttaaaatctaacttggtatcaaacgctgtattttggtgttcatcaatggtttccccttcaaattcatttaaaagctaagatattatcctaaatctgaaagcacctccaccaaaaactcctttgatccttgcatctgctcctttgatactttcttggacatgatttctgttcacttggatgagaagaacttattccatcacattttctctccaaagcagatcaagatatcggtcgagtcattgaggtttatctcacgtcaaaagagcttgtgtatatctatgtatgtctgactccagtctgaagcaataatattttttgcattactgcatataagcccaactcnnnnnnnnnnnnnnnnnnnnnnnnnnnnnnnnnnnnnnnattgaaatcatggttgtttgaattgatatttttaacattttatgaatcagaagtcagataaaattcaattggcatatttgatattttttggttgaatctttcattctgcaggtgttcctgctgcagtccaggttgaaagtcttcaatgctatgcatttctttgtagcctgtcacaagataaatggcaaattgaacttttagctgaatttccttctgttcttgttccattggcgagtgataatcaggtatgattctttgttagcgttactctctgaccttgtgtgtatttttttctcattttctgcaaactgccaatttataattgtttgcaaatggttatcctctgttacttttttggcttttttctttctgagaaaatgtgctcaaatgatttctttgcattgttttgaattttcttccagactataagggttgctgccatgaactgtatcgattcattgcgtacattgtggtgtcatgttgagcgttctggaaagaaaaatggtactctattgtcagaataatttgatgtagccctcaatgcctaattaattttaccttggaactttataagtttctaaattggtatgaacaggtaacaatgcaatgtggatccattttgtgggtgatgttttggcgttgatggatcagcaaaaaatattcatattgtctgacaagaaatttcttccttcattgtttgcgtctgctatgagctcatcctgtccaaacatcttggagcctcgaaatatcttggtacctcaacatatagaaaaaaggtatttatgatgttactatgacaattatcatttcattgtcaccaatattattaccttagaactatttgttatattcattgccttagctgctgctcatcaaatatgaccatgctctcttgttctgttgttggaattagctagatcttcttaaatgtggagagcagcattccccttttctttttaaaatctaaatgatataatgtttgacaactgacagtaaatttccctttgtcacgggaaatgatggttctgttgctgttcattgtccccattgtaacaactcaaagttcataaggattggagggatgcatgacaaaaagaaagtcatatagggaaggggaaagtaaatttaagggtgggaggagaaagaaatggaaatttaggtagatggcatagagggttctctaggaggttcattcaatgttaaatgtgactatatatatatacacatatatattataaacagctgagaattaaaatggtactgaaccaatgcataaactgtaggatggaaccttgacagttgaatgatcctatttttattcaaaacctgtttattcaaaatcctaacttagtacaaatgctaatcaattatattgcttataaattttgtaattatgggttttcacttgagagctgtttttatctattgtgttgttctacttctttattatggttgttctagaatgattgcttatcttcttcttgtccttatttatttcctctagatgaattcttcgataaacttgaaacaagaaattatgataaattccaaactaagcaatatgacactctagtttggagtattttattaaattgcatccttaggctttagtgtgcatgtgtatgtgtctctattatatgaccaattgacattaagtgtcaaattttatataacatcaaaccctattccttccttctcctttaatctaaaaaaggccaggattgattcactgaaccaatcacttgattaactgttttctcttcccgctacatgggccccgcctttgtatttttattgcttttgattcttttttccttgctgagtgctgacgagattgtgataagagttcttggctagtgtttccttttgggctatgaagatatagccatgaatggagtcattgcaaaaatactaattgtaaatatagtctcttcctaagaaagttcaagcaggcaaagttgctttatgtaccatacataaagacaagtctctagtagagactctctacaatcaaagaagccagcgaccattaattaaatgaaaatatgacattataaactagaatctcataagcgtcccgaagcgatccttttgggtcaccgtgaaagcattaaatgataatgaaaggtaggatttggtggtaatataaaatttgacacatgtacagtcacatatagactaacattgttttattttctttacatataagctttagtgtttttgtttgtttaatattacatgttgtgcggcttacctttttagtggactttaagctgctgttttgtgttattgagattgattgttgggatagaataggtttagaatattctgttgttattggttctgatacttatgctcattgcttgatgcatatatctgtgagtcttatcttgtaactttctccatcttacttttaccttttcattttgcttgttagtttctgtttttatttttttcaagaatgttccttatcttcattcattaaaaatgttcatttgtactaatttctaagattctttattccactttgttcccaaacatatcttttcaggtttgaccagcctacaaaaataaaaattcttggcttcattttgggttccactcttaaattctctaactatgggaaggtttgatgtcttaacgctcttctatgtttctattatatttttagttgtggagatatacagatcaaggtttcatatgttcagttccagattaacagtgttaagtgagggttttttgtgctatgccaagactttaaggaagtaacttatttgttgatgttggatgcagctaatgattttatccttattcaaaggaattgggaatgcccttatgcacgttccagaagttgggccgttgttgtcttcttttctggagcagtactataatgagctcaataagtcttgtccaaagttgtcaaacactgaaactcagataatgtgccttttgctggaggtatgtgtattgtatattttagttttagcttatgggatctttattatgaggtttggtgtgaacttgttcctcttcatgcgtagagctgtgttatgtcatctccctccggtggaaatgatcttcaacatcttttactgaaagctttgcgggtaagatattaagatgtgtgttttacttatgttatgtcttgttattttgaatttactgacttacattcttgggatctttcagttgggcggcatgacatcagatgaccctgcctgtgtaaagccttgtatcactgtcttgaacaaacttaacaatcaattctatatgaagttgaagaatgaagtgaaggtcttattggcagtatatctatttattttcagagtttgttgttgtcattcatgataattgatgagtatagctaatgatctagttaatgagtttatgataatctgtttcatagtgtaaataaaataattatcaccaatgtagcttttactgtgacctaaactaatagttttttcttatgcctgtcaggagcatctattttgtgagctcgtgattttgtggcataatgataatggtgatgtacaacgtgcaactaaagaggcattaatgtgcatagatgtgagttccttgctcttgatcaaatatcatgtgttctgtgtgcgatttctttagtggttacttgcaaagaacttaatcttttggtattattcaatctggacctttggggttttcatccctttaagaagggtgtttattttattttatttctgtttccgggggggtggggttgtggatcttggatccttttcccctttactgtggttaatgagctccgttgttttagctttgtgctctctgattctggacaaatcatggcctctctctttctatggcagtatttccatctattcccaatcagaccgtgatggtttctggctgttgaacttggcagccttgtgttctatcctccgttatctgtgtcactgttctgttctgttccttgctttttatttgatagcagatttcactgtgaaacaggtgtttcatcattatctgctgggtgtttagcttcaaattcatcaattgacaaaatggatgatatgtcattattcatcaattgattgtaaatttttttaaatgataagataaatgttttcttttaaaaatccttaaacagttaatatggtagtgacctgaggataaattttaacaatgtaaattccattgttatctgaccgaagcctttttggatcaactggttgttttgcactatcaatgttatttgttgtttgttttgcactatgctcttcaatgtccgatctcaccttgtggggtaagaatttgttgttgtttcttttcattgtagtgggaggtttttttccaactttttattccacggaaggaaaaaaaagaaatgaaattaagaataattggtggatatattggaattgcagattagtttctcaactgttggccacatgcttgatcttatacttgcacagaagagttgtataagtagttcagcagaagaaaagatggtgaagaaacaaaaattcataggacatcaagaagcaggatatcctcctaatgacatattcagaagagttaatgcagtctacatccttagttcccttcttgatgttttgctactgaagaaggacataacaaacaggtgacttggttacttctgaatctgaacattacattatgggtactgctgagatgagtagttaaaacatttaattgtgctaaattctcagtttgattgttgcaggcatttacttttagggcccttatttaagcttcttagcaaggtattttcagaagaatgggtgaatggtgccttttccccgaagataaagttaagccaaccttcaagtccttcggaagccaacaattacacaatatatcatattcaacagactctgttgataatcctggaggatataattatttctcttaaaagcatggatccgttaaatgtatgccttgtgaagctggaaaatttattatgttgttagaaatattattttgactaccttttcactattttagctatttccttatattattaagttttgccattgttgacaggaaaaaatgacaaatgaaattaacattaagctattgatagagtgcgcccggaattccacagttgcagtcacccgcaaccatgtattttctgttctctctgctgttaccagagtctttccaggagaagttttggagcatatgcttgatattctagaagttattggacaagctgctgtcacacaggtttgttaatacagggtttccctgtactgaacttagggcattcttttggtagagtagcttattagatccttttcttccctggggaacaatgttatttgtgtagaatagcttattacatccttttcttatgtttccatgcttgttggaaagttccacaagtcctacctcgattactagggcgtggtttttatacttgtcggacaacctcacttaatgccaattagttttaagatgaaatctaacatggtatcaaagcctccagccatttctgtcatttccgagtttcctttgtgcatcacttggtcagcaggcatctgtggaaggggagggggtgtggaaactggaaaatcctacatcacctacctcaattgttggatgaccttacttttagttgcagtatttaatagaaattcttcacaattcaatttattagggactaataatccagtgtaggaactgtggtgtcatcatttctcttttttgtgtgcctgtagattgacagtcattcgaagcatgtttttgaggatcttatatctgcaattgttccgtgttggctggctaagacagatgatgtggagaaattactgaaggtttgtttttcacagaaatgatcttctgctgcttgatacaaaagaatctcttagcagttcaacctactaatatgtttttttttcctccagattttcatgaatatattgcctgaaattgttgagcacagaaggctgtcatttgtgttatatctattaaggtattcttgttctacttctacagttctacatcatgatcctgctattgatactttagccattggtttttggcctgtgtcttataatgatggctgttttgcagaactttgggtgagggtaaaagcttagcctcattgcttatcctacttttccgttcattaatttcaaggaaagctgcctgtttccttaatgttgagatgcaagatgttttaacattttataatgaggagtgggaatataaatttgcagtgcaaatttgtgaacaatatacaagtacgatttggcttccttctttagtcatactgcttgaacagaggggaaatagtgatgttgaccaggcaatgtttctggaattgtttattgtaatgcaattttctttgcaaaagttgcaagatccagaatttgtgtttaagttgaaatcaggtgaagatacctcagtcattcaggtataaatccatatcagatgcatgctagatacttgtatgctttttaatgtctttattcagttctataaggcaaagtctagatgtaacttatattatgatttttatggatagcttctatttttgcctgacccatgcccaataatgactagcagatacatacagtatgtttttgagatgttgatatctcttaactcataaatttggggatactatgttgacacccactggctgcaatgtggcgtcaccacccttgctgcttgtgtgcaggcaaagggacatggtggaaagctttgataccaattgataagaactttgggagagcaacaccacaaaagctagccgttgtacttagttagagagcccgaggccttataaacctcgctagaattgcatacttctaatgtacaacttgattcccatagcctgcaattggatcctatcattaacatatatcttccctgatttattaattgaaggaggtatgtgtggggtaaaaaaaaatattgaatgtaagtttaaggggtgtcaatgtaatttgcctgacaaaatagtatgatacacatgatgaagttaaatttctatcaatcagaaattgtgattttaaggtgagggacagatcttacgatgatattgaagcagaagcagatttcattattatgaactgaaatattcattctttgtagaagaatttatatcatatttgttttccttttctttgtaggtttcatgctgagatgctgtttttggtttttgtgagtgcaatggcattgatgttgcatgcttcttatatttgtgttaatgttgtgatctttgaataagcctataaacacttgttttttttagatgaacatatttatcagaaattggacttagggccctaattcaacccgactaaactggcttgcaaggtgaggactgcccaagcttgataagttctatttaaccacatgtctagttgatgtggaactaaattaccacccttgaggttgcaattaaggcaacccttaaagaggccacaactaaggctaggtgtgactggaatttagacaactatccaacaatattcattatcaaaacctgaactgaaatattctttgtagaatatgtcatattttgttttttctttgtaggtttaatgttgagatgctgttttggtttcttattgtgatagcaatggcattagtgttgcatgcttatatttttttttttgttttgcaaatgttctaatctttgaataagcctatattctcttgtttatttagattaacctattcataataaaaataaatgtgatcgcttcttgaatatttcagagggcattgggtgcgcttatggagcatgttgttttactcatgcaacttgtagatgcaaggaaaaagcaactgaatttccctgtaattctgaggacagagttgaaagaaactatgcgtgcacttgcaaggaatctaacaacagttatgatacctgtcatatactttaagatcataattaaattgcttcgccatgcagacaagaatgttggaaaaaaggtatggtttttaatgaagttacaaaatatgagattttattaggatcttgtattattttgatacaagggtaaaatggtaaactacaatttggtggtgtatttatctgcttcatagtattctattaaacatcctgattttcaagatgtttacttaatttggtgggtatacacagtggtcatttattcttttttcttatgatgattgggttttattcacatgttatgaatacagttggttctatatataccgtaaattgtttagttggtattgcccacacatcttggtaaattatttatttgccttttaatatgtgagcatgagcgcacaataagaagccaaaaatactaagggggtgattacttgcacttttgtttcctgtattcattttctgttttcactttttaattacaaaaataccaccttgttttcaatctgtttcctgttttcatttatttgtataggaagcgctaaaaacttttttccccctccatttcctgatttgacaatcggaaacaaattgaaaacaaggtgacatttttgtgactaaagaaaacagacaatagaagtgcaagtaaacactccacaagtttttaatagaaaagaaagtattgatatatcgaaaaacataagagtcttccaatgtttgcacgccatgagcacggtatagaaatccacatcttttttgtggtgtgaaagcaagacagtgagaactgtgatttgatatttgtatttcttgtgctgcaggctcttgggctgttatgtgaggctgcaagaaatcataaaaatttcagtttaaagcttaaagacaataaaggttcaaggtcaactccaagttttcttttgcttcatatgagtgaaacttctcaagaatcacttaataaattgtgtttagaaattattcgagtacttgatgattcatcaaatacctccttgaaagtggcagcagtttcagcattagaagttctagctgaaagatttccttcgaataattccatctttagtctgtgccttggatctgttacaagacatattgcatctcataacttggctgtgacttctagctgcctcagaacaactgctgccctgatcaatgttctaggtccaaaatcactggcagaacttcccaagattatggacaatgtgatgaagtcatctcgtcgagtattggctagtttggatatgaaacccgaaaccaccgatgttttatcagcctcaaatgaatcccatttttatgttctcatcactttggaggcagttgtggacaagcttggtggatttttaaatccgtatcttacaaatataatggagcttctggtgctttatcctgaatgtgtttcaggaatggatgtaaaggtggagtctagagctcatggagtacgaaagcttcttgctgaaaaaattcctgtaagacttgttataatgtagcattgtgtaattgtggtatgaaatgaaatacccatttttttctttaccaatcactttatttttttacaggttcgacttgccctgccacctttgttaaaattatacccagctgccattgaggctggggataaaagcttaacaattgtatttgatatgttgggaaccataattggtacaatggacagatcatctattgtggcattccatggaaagatatttgaccattgtttggttgctcttgatctgcgccgtcaaagtcctccttcagttcaaaacattgatgtagtggaaaaaggtgtgcttaacacaatgactgttctaaccttaaaacttactgagagcatgttcaagcctcttctgataaagagtattgagtgggcagaatctgaagtggatgaaactgcatccagcggaagcattgatagggccatatcattctatggcatggtaaataagcttacagagagccatcggtaagtcagtatttagttagctagttattgttcgctttagaaaatgttctttgaaataagcatgctttgaatttagtcaaacaacactttatttgggtttctaaatattttgggtatattttgtattctctgaagaagagtttagctttttgtttgtattaaattatgtacatgtgatgtagatacgaaaattgggttttgaaccactgtaaatatgtcaaccacttgtgacagttgagacttgtacaatttggtcgcagtatttaaatcagtagttagttttcaatgtgatttccttaattattttttatgtttatgccaataaacataagaatataatcacttgttatgatgttaccttgtttacccaaaataatgatcaaatcacagcagtttaagatggtcctatatccttatttgtaggtcattgtttgttccctacttcaaacacttgcttggtagttgtgttcatcatcttagcgatggtggagatgtggaagtgtctagagtgaatcggaagaaaaaggccaggattctagatgatggcaatataaaagaaataggcagtgtgtctatcaagggctggcatctaagggctctagtcttgtcatccttacataagtgtttcttgtacgacactgggaccttgaagtttcttgactcctcaaatttccaggcaagtgaattgtttacataataagaactcattttttcatctattcgtatccgataccaaaacttttgaatacttcactgatacgcgtctgtgaagcatcaagcctttttaaagatatgaaaatctaatatagtttacatattgagacatagaagcatgtataaaaattgaagcattgtccattgatgcaccaaaatggaaactatcctctttatggatgatctcaaaaaagtaatgagattgatactattttgttggtagattaataggacttgatttacgatgatttatactttttaaataatgtgcaggaagtatgcttttaatttgaatttgcagaattttttttacatgtctagatttatatcttatacctatcctatcctatacatttttagaataattgcagtcatgtcagatacttttcatatctgatatatgtatcgcatgggcatcaatatctatttttaccatttgaaatggttatgaaaaaattctttagaagactttttttccacctagagtggaattttttaaaggttatgcattaattgggaatttttcctttccatttaaaaatactttgcattttttctcattccattgaggaataaagtattcctaagtctttcagcttccttcagtaatatagttgcttgctatattctctcactgactgttatgtcatgcttgctgcagatgttgttgagacccattgtttcacaacttcttgtagatccaccagctctgttggatgacagcataaatatactaagtgtgaaggaagttgatgacctactggttgtgtgcatcggtcaaatggcagtgactgctggatctgaccttttgtggaaacctttgaatcatgaggtgaactttatgatttcttttcatttttactactcgttaatgattgggcaagtaatttgatactgacatactggtaacttactggcttcactatcttgtttttcattgagggaaaatgcatatgatcattgtcctcgggaaacactgttatgaatatgactggttctactattctccctattagtttgggtgcatggatgccccaagacattttaacaatagattaagaatatgtctaacagtagaagtaattaactctctaaaggccataataaaagtgtaaatacagatatggccccccaaaacttttaatttaacgaatccactcctcttacatgtaaacattcagtcagtagctgtggtgcagcagcaagccaacaagctggacggggcaaatgggctcctagaaatgccagcaggttcaaacgtggagtttccaacattagtcattcaaactagaaaaacgagcaaatccttaccaaaacttcctttgctagacctccatttgtggccttgctaacaactacctatcaacatcacctaagcatagtaaaatcatgtcctatttgggaaaactctcaacaagaacttctaagagaataaaataagtaggtaaaatggattgagtttcttaagttgaaattaacgtgagttaaaacaagttttttgagaagctaaatcagaacttctataaaagtttattttaacttatgagagaagcttaattcattttacgctctttttttccttattctgtaagtgcttattgaatagtttatctgaacagggtttcagtcatgttagagttgaccttttctgctatgtttatcgggctttataaggtttaattgtaaatagactgtagcttttatgtcattttgatcaaactttagtaataatgtcaattgacgcctgcggttttgacctaccctaccggccaatgatctttaaagatctgaacttgctcctgtactcttgcatcccatttcatagtacgttagctttggtcctttgtagtcatcaatgcctcatttatgtgttgaagtttagtccattagtttgttgttaatagttttgggtattcagtaatatgtgttgctcttgaatgctatatgtttgttccccgcaaatactagtattccttagcaactgaatatctttctgccttctttatcccgttttttgcaggttttgatgcagacacggagtgaaaaattgcgagctaaaatattgggcctcagaattgttaaatattttgtggagaacttgaaagaagaatatctagtgttcatagctgaaacaatccccttccttggcgaactgcttgaggatgtggagctttcagttaaatctcttgctcaggaaattctgcaggaaatggagtctctgagtggggaaagccttcggcaatacctatgatgtaagattaggagggcagtatttatggttgtgacatgagcaaagagctagagatatgtaatcaaacaagaaatttaatcgataggccagtgtaaattgtggttaattaaggaaaattagcatttgtatattccgataatggttaaagttcaatttttctcgttcaacttttataacactcaatcatttatagcataatgcttttaagaggaatatttgtaataataaagagagaagaaaaagtataaaaataggattaaattgatttattttgaaatttgatattttttttaatatcatactacattcccagagaaatttaatccaagactcttgcagtctcttatattttgaaaagtattctatttttttttttttgtatctctttcatttataaaataatggttgataattttggtagctttattagggccgtattaagaatagtggaattaggaagtaagacaatggataagcaatgtacctgcttgcttgtggcattgatgactggtttaaaaattaggtacgtgttgttacattaattatttttttagagaacgttaattgttcttttacaaaaagaatctgaaactgataaattgatggaggctacggatcagcgcggcagatgcaactgtaacatcagtttttttataataatttttaattctatcataaaatcaagtattttaaggatgaaggttttcagtagtcttgaaaaatggttcgtgtatgatcaatgaaaggaattgtgggaaatatattacgtagaaagtggccaggtaaaagtttaaaaaattattcacgttttaacttttgattttcagactataaaaaatgtttatgaaatcaaaacatacactattataagttatatataattcttaaaaaggatggataagacataaaaatataaaaaatatcacaactatattgacatccttattttctaagattttataccaatacccaacggaaatttatatacaaaggaagaaaaaaaacaaaatatgggaggattagaccaaggtccatagccaaatcaacaaaactcatagcagctcattaaaattacgggcataacggtgagagcaaaaagggggaactgaatcccagcaaaaataattacgactgagaactgcaaaattagccaactgatctgcagagtggtctccttatctatagacacgtgtagctttaaaactaatatgactggatctataaacacaattgttccatttagtggaaaacttccaaggaacaagattcaggttatattatttataattttatataaaatgtaattttatcgatctaattattaaattataattatatgacattttttgtttttttaaaagcaatttatacattgttagaacacttagtaacaacacaaggtgtgcctaactaaggccaacataacatattgattagttagttgtttcaattttttttaatcaaattaaagttggacaattatataatttgttaagtaactctgaaatttagttaccttttagtatgacataatagcttatttaattttgtaacattttgcttaatgtcaaacatagcacagagttactcaatacgtttgacagcggagtttatggatggagaatcaaataatggcagtgcactttcatgttacactaagtgcacgctacattaggtgacttatcaaacaatagtatgatgaaaatgctataaaattatttattaagtttattttctaaattatatatgaattttgtttgttttaaatgtgattttcaaaaactaattgtatataacatttatattatatatgtgattatttcatcctcaataaaatttcaaaaacaaatattagtttaaaaaaaatataaaaatatctatggtcataattgaaagtaaacattaatattttttaagatgaagattctgcaaccatcattttatttatttataataaattagctatcatactgactataagaatctacttgctgattatatattagattaatatttgtattgttcccgctacactactcataccataggcatcatcaaatcctttttaaaataccaagtgggtcaaagttgggattgtcttccttccaggctgaacccatgctaagctatgaatattaatgaagcttcgtttgataccctgttagaaatcgtgtggagtcttttcaaatgatatatcaataattgctttatgagaatgcatgtggagtacatgtgccattatagaaactgcagaatttactttaatttgttacgggtcacggggtgaattgaattctgcacttgatcagcaacacccatcttccacgcatccaacagttttaaatctttttacatcatctttcttaataatacttttaatcactaaattaaaatattaattttgtacaataaaatattaaatacatttaatttttatttaacattattaacaaaacttattataaaaaaataacattaataattaaaatttagaatataaaatacaaagtatagtcaaaacaactaaagaccgtgctccaccctctttacccaccccctctctctctcaactactactaattttataaagaccgtgctccaccctctttacccacctcctctctctctcaattactttataatagaattttttctatggagaaaattccagagtttcatatatgtttatatcgtaatgaatatcaagcttaacgttatgtgttgttgtgtaggatgacgttgctgttaggacctccaggatcgggcaaaactaccttacttttggctcttgcaggaaacttgaaagcaacctcaaggtagtacaaattctatgcaggattaacattctctacggtcctaaagaactaataattaacattaatttaattatgactaataaatattgtatgtacttattatgtacaggatttttacactgttattaagttacaaactgtcatataaagtaagttagttgatatttacgataactactttataattcataattgattgacaattttaattttggagttcatggaaattaaactctataaccatcatccgtgtgggttatatacgtgtattactttacaatttgtaattactaatattataggtacctttcggttctttgaaacaaatattaagctattacgtagggcatccttatttagtcaacattttttatttttatagaataggaattgagtaaaaaattgtgcctacatgaatgatcgtcttgttagtgtattccagttatagcacaataacaagtgaaacactgaaaccaatgtgctttaaatcattataccaataggaattaagattgattctatttttatagcctttatctaactggaacaagtccatttctgaattgtcagcataccaagaattttgatacgccatagcattcttcaaaattccattctcatcatagaattacattagaactttgatccttaaatacctgtgcagaaaagtggtagtataacatacaatggccatgagcaaaacgagttctgtattcaaagggcttttgcatacactagccaaactgataatcacatatcagaactgacagtgagacaaacttttgattttgcaaacagatgccaaggttcaagtgatatagttatgtatataatatattagtttccttatgtgccatttttagttatttttattttccatttcagaattcagttacttaatttcctggtctaatgtcatgaacagaaattgtgaaaaatcttgaacgcttggagaaggagaaaaacatactgccaagtccagaaattgatacattcatgaaggttgtttcatcttgtaaataatatctgaaaaatcatgcatatatgcaagttaagagaagtcctctaatttgtgtttttttaaactgattttactcctcaacagaacacttgttggtggcaaaaacctcaatgttaagacagattatgttttgaaagtgccttggtcttgatgtatgttcagatacggttgtgggcaatgatatgctaaggggggtctctgttggccaaaaaatgagagttacaacaggtgatctctcttccctttctaggaatttgttacaattttctttgaaatttggctcttgtagtgatatatgcttaagttaatctaactggattacctcttgtatcatacaaagaaagagggtccaaattcagtccctctattttttttcttgttttgtgaaatatagctttgataagatttaaggagatttcatttagaattttgtttttgactcctaagattggaaattaatatataataatagagaagctaacacagtccatacatttgaatccatatttgttctaggaacaataatttatagatgatacaaaattcaatccatatttgttttgactgtgtctataccggaagattaagacattatgaaggcactaattgaagttaaaaattgtagcaagcaatgacatacttttgcctttcatattttttctccaagagaaatgattgttggaccacgaaaagctctatttatggatgctactgttctgatagctctaccacatcccaagtagtgaaatgcataggaaattttgttcatcaaatggatgctactgttctaatggctctacttcaacctgcaccataaacatttgagctctttgatgatcttctgcttctgtcagaggggtacgttgaatatcaaggccccataggagacgtgctggagttttttgaatcattaggcttcaaacttccatcctgcaagggagttgcagattttcttcaagaggtatttgtagatttttgctcctctaatggttaaactcaaatgcttgatgaaattattgcttaaaaacatgttattttcccgtgtcaggtaacctctaaaaaagatcaagctcaatactgggctgattcttcaaagccatataaatttatttcagtgccggagtttgcataagcctttaaaaattccagatttggaaagtcggtataatccatgtgtactactccctttgataaattaaagaatcatacttcagctttgcccagaactagatttgctatgccaaaatgggagctctttaaggcgtgtttctcgtgcgagagaccttgatcaacaggcgtaagtttctctatatttttaggacctgccaggtatgtatatatactcaagtaaataaggatgcacttgtttctatatatgattttcaattcttaagtttttttacaagtagaattcatgataggttggcaaaaaaaattacaagaatatgacagtttcaaaagtattttcaaatctattgcagtcaatcacgtcctggctggacgtgttcaaacacgccccagccaggcgtgattcaggtccattcgcgctctccccagacgtgtttggtcacgtctccactaggcgggataggtgaggcagtcacgccccacccaggcgtgatcttgctaaacgtgattcttcactggatggcgtggggattccgcatgtcattcggtgagaaaattgtgttcttcttggggaaacccggggtggcgctggacgacaagtttcttcggggaaaagcttttctgggattctttcccactgctacgatggtgttttttcaaggcgtttttgcggggatcactttgatcttgaattcttgatagctggggcgttgctcgggaggatgaactttcgtgggtggatgctgtttgtgccgctttggcttactttttcgtagactgtcactgcctttagcatttggtgccccgatggctggttagcaaagcttggggttattgatttctctggcggatatgttattcacctctcctccggagttgctggtttcactgcagcttattgggtcattcacttttctctaacttatcacttttacccaaaaattcatttaaataactagtcgtatgtcttagttactcatttataatcaaaattatgaataaatacttaaatcattgttttttaaaagtaaactcttagtataaaaattcataattgtgtttaagttaacaaataaattttgtgatatattttttaaattcttacaccaacatgttgatctaaataaaattagactcaatttttttatgtaaaatttcattatgatgtataaaagaattaagagtaaagactctacaataattggttctttgtctagttaattgtatacaattaatgactaatgttaattatttaaattttttacaaagattaatcgttcataaagttaataaatactctattgtatcaataacttaaaaaagaatcttatattacaatttaaagaatctcattaatattgtaattttttaaattttttaaaaattattactaaaataaaactcaaacaaacggccttgaaaatgcagatcttgttaactatatgcactataattatcataattgaaaggtatataataattattttgggttatacatatacaacacctaattaaaatatatgtaaaaatatatccacgcatcatatcgcataaagaagaaaaaaaagattttttcatgtttcaactaaaatataaataatatgggtgatattgtttttttaaaaaaaatgaatgattatggtacgtaatattaccaaacaacttttgaaataaaatttaattccactcttaattttatttatatgtacaaatatacaatgaatattcaagagaaaggattacaaacatttttgtgtgaataatttgaagcagttaattttctttataataaaatgctgacatttgcattgtgatggtgtttgatttgaataggtgggtccaagatctgaaaaggacagagaaatatttccatcaaacaattatggtgcttgcaggcgcaggcctgctttggatgggttggagtgggttcaacggtggaggtccgtttgtggcgagcacgatggcatctctggccgtccttaacacacacgtgtgtgctgctgctagcatcatcgtcggggtcctactcgacactttctactttgaaaagctttccccaaaagaaacttgtcttccagcgccaccccgggtgtccccaagaagaacaccattttctcgccgaatgacacaagatcacgcctgggtggggcgtaactgcctcacctatcccgcctggtggagacgtgaccaaacacgtttggagaggacgtgaatggacctgaatcacgtctggctggggcgtgtttgaacacgtcatagatttcaaaatacttttgaaattgtcgtattcttgtaattttttatttaaactgctattttttaatttttttgccatgataagttagcctaatgttggtgatttcttggtatcacttacagaattttgtttgcacaatgcttgtgcaaacaaaatttcatggtaaggatgaggaatatggcaatctctatcaatctgcactatttttcagattcatacacatgatgtttaatggccattctgaattgtcactcatgatagcgtgtcttttacaaacaaaaaggtaatttatttatcctggacgggcatggtctttggccacttggatacttggtgtaccttattcccttgttgaagctgttatatggtcttgtgttgtatactatagcttcaacaagggaataaggtacaccaagaatacaagtggccaaagaccatgctcgtccaggataaaataaattgcctctttgtaaaagacacgctatcatgagtgacaattcagaatggccattaaacatcatgtgtatgagtccgaaaattagtgcagattgatagagattgccatattcctcatccttaccatgaaaatttgtttgcacaaacattgtgcatgtgacaattccaacaaatgttactgacaaatattttgtaagtggtaccaagaaatcacaaacattaggctaacttatcatgaattctacttgtaaaaaacttaagaattgaaaactatatatagaaacaagtgcatccttatttacttgagtatatatacatacctggcaggtcctaaaaatatagagaaacttatgcctgttgatcaaggtctcgtgcgagaaacacgccttaaagagctcccattttggcacagcaaatctagttctggggaaagctgaaggatgactctttaatttatcaaagggagcagtacacatggattctaccgactttccaaatctggaatttttaaaggcttatgcaatctccggcagtgaaataaatttatatggctttgaagaatcagcccagtattgagcttgatcttttttagaggtcacctgacacggggaaaataacatgtttttaagcaataatttcataaagcatttgagtttaaccattagaggaacaaaaatctacaaatacctcttgaagaatatattaaaaacgaataccaaagacaaaagacatcaatgattgacattgaatattaaagttatcgatgagaaagatttaaaaatttgtaataagagttgaaacttgtaaacactcacatatcctcttgtctcatcgtgacacttgtggatcaatgaattattacaatactctcaaacattttaatttcagcactttatcttattcattttatcgctttcttttacatttgttatacttccctttaaatcttcatcttttttcaatctcaatttcttctccaaactttttactcctttaattttctgtatctttttttttttgcccactttattttcgtcaatactcttttattttaaagttgttctgtgatcaatttgcactttactctttattacatacttttagtttgttctcatgttaaaaatttaacattaacctatggtacagtacctattgaggaagatacaagactttcagagaaaatgtttatcctttttctcaaatatctatgggattgtgtcgactaaaacaagcacaaaatttcacggtcaaaatactataaactatttcaaatctttttaaacttgcagcaatcgttttactattaactaactaaaatcataatgcgttaatcattttttaagggtatttgtgacactgcacaatcttgaatatcttcccggcgggatacaccccaaaatcaaaagttatcatgcaaggatatgtttggtgtgtcttacgaaattcgattatatacatcatgaataactatgtcggttgattctcaacaaaaacatcattcagcatcttaactgggtaattgtcttcaatctgtttaatgctaaagcttctttaatctaactcatacaattatttgtatatgcatgacatttgggaaatcaaagtaaatatgacttaaacgagagtgtgtgtcacaatttcaagatgacaggcctctggccatggccctcaggacatatatattcacctttctagaaattgctaatgttctaagtaaaattcagacttccaaatcaattcctcagtgctgattgtaagcattacgactattactatcaatttgtgagctaatgactgctcatagaaccatctgtaatctgttgaattgatcagttctgccttctagttgacacttgagcgagggcttgatcgatttaagccattttaaattttactggccatttccacgattttgtcaataaattcatattcgtacctacaaaaatacaaggccttttagttcattcatacacaattttcattttctttctaaaattatcaaagtaaatcagcacaaaagtaattaccacacaacaacaaaaacagaattgcaaactctaaacaaagccttaactccgtaccccaatgtctctcacaacgttattccttgttaacaaagtcaaatttaaatgaacggatttcaaattaaacggttcatagaatttcatgaacgatgcacatattaagtgattattatgatcaactattactagtataatagacatgaatcatgaaaataagcaaaaagtaaaagaataatatgtgttgtacccggttttcaagtaaaatcctttcaagttggcgacatcaaacaaagctgacctccatttcttcaccctctcagagtccttacccaacatattttcatgctcagtcatggcttcaccatagctatttctttgatgccttaaatccgacggtaacactttgtaaaagatgggacaaatcagttggtttttcgtctccatacactgaaggatggtcaaaagcacatcaagacaggacgaggaacgtgcatatttttcagaaaatacaatgatcgaaagccttaattcttcaataactccattagtagattgtgaaatttggtccccatcattcatgaaggtttggtacctactccggcacaatgcattgttcagaaaacctgtaaaggagcgggtatcgtttccactaaaactcagaaaaatgctatagcggggtacaatggcgatggcttctcgcacaatgttttcgatgaattcatattcatattggtacctacaaaaaagtacatgaccttttaattcattcatgcactggttacgtttttctttatctattattgattactttaagacgggttcaagcaagaaactctctcacacacttgcacatttcttacaattaattaaaaattatgaatgaaaattattaagtaaaaagtgagatctataaattttataattttaataaagagtgcttaaaagaattttttttaatataataaaattgagtttgaataattaatttccccaaagatttcaaaccttaaaactcgtaagtcaaaacaaagtaaaattaacttgataaattagctaaaagcttagattgtttcttaccaataataaattctagtgtgataattcataaaacaaattccttatcaaagagtataattattgttggtttctattttgtttttcttttaagaatgaaaggagaattaactagttacgttagattgtcactttaagaatattggccaaagccttgcaattctagacataaactggctcaagcccatgttaacgagtcatttgacaactcagaagttagaacattcaataaggtataaatcaaggaaaaaagcttcgtgcaaatatcacaagtggttttggtctctgaggattaaaatgcaagtttacatgacttcagcaataataatcggcatgagttacttaacttagtatatgaaattttaatttcaacaatgatacataaacaccatcctaggctaaaaattcatttgatcgaaacattttatttttaacttaaatatctttttaattcttataatttaatatttatttttttgtttttataaaattattttttgttttaatccttacaaacaatgtttatttttattttggttcttataggacttttttttttactatctagagtactatttaaagtaattttaaaactaaaagtaaaatatatatatatatatataatttataaagactaaaaataacaaaaattacaaaaattaaaaaaaaaacactaaactattaaaaacatatttacacctatatttttcattatctctcttattaatgtcacgttgttctgtgtttcttttttctctcaaagtgtaaggcagtattgaatgcctacaaaaaattattattttcattttctttttttaaaattaagaagcggtactagctaaattaagaagaagaaaaaacgccatacctgcttctgaaacaccatccggacaagttggcaacttcatacaaagctgacttccacttgtgtattttctcggagtcctttcccaagcgactttcatgtttaatcaggcactctccgaaaccaccagtctgtttccttacatgggaggggtccacgtggtaaaagattggaataactagttggttctttgttgcccttaactcaaggatcttgacaagttctttaaggcaccacgaggaagacgcgaagttttcggagagaacaacgattgaaatcctggatccttctaatgcttcaagaatagctgctgcgattaggtcgccacccttcaacccaccatcgaagaaggtcctcaatctcgccttccgcaaagcagcatagagattaccagtgaaggtgtggcgcgtgtcttcccctctaaaacacagaaatacatcgtagcgccacttcgcaattcccccttcatccgccatcgcaatgaaactattaagcagataacataagatattatatgatgtgctgacactatcatttacgcgcttttgcttaatttccttgctgcttcctggaaataaaatacatggatggagtccttgttttcttctccattttctattcgaaaattatagttgtcccactcaaatttgtgcatttcatcaccacttgaaaaaaaatattatttccttaatctcattataattgtcacaagaaaaaaatctcaaaataattattttattattattttaaggtaatattaattatctttttttatttatatctcttatgagattaataatagacaataaaatttataaataaattaatgatgatataaaattatcattctttttcaactatttatatataacaacctaaaaatacaattataacagaatgcagaaattatattgtatgtataaatatagttgattttactgtgactaaaaattatttactattagatatagttaattgcatgcaaaaatataattaactttacatcacaactattaattaactttgtatcacaagcaattaataatacgatgaaatcattaaaatatataataataactaaccacatgaaataaaataattagtttcaacctaaattctaattaattacaaacttacacaatatttttgccaaatagagagaaaaaaaagattattgtctaaatgtggatccaattactttgaatatatagaaattattaattgtatattctattcaaaataaaaataaagtgcaagagtcatagctcaaaatgaacctccaataacagaaatccacaagcatttttcttcatgcactagacaaatttcttcatacacccaccaaagacaacgaaaaataaaaaatattcttccataagattcatacggattggcaatccgtaaggttcatacaaattgaaaaatccgtaagaatcttatggattgcaaattcgtaaaatcttatgaattacatatcgcctcaccgacctcgtcgatgctgtcgatggcgagattgaggtggggattgtggtcgaggatagagagggggatgccgagggagtgggccttctcttccatgcggttagaggtggggaccccgacgatgtcggtgagttggccaaaggctgggagggcactgagcttgacgacaacaaaggatacggattggccaatatgtatgaaccttacggaagggtattttcagtttttcattttattgctgggtgtatgggaacactagctagtgtaggaagaaaaatccaatccaaaattgggacaaaatgtaggacttaaccaaatggtttgaacatacttgtgatgatatttgtgataccaaggtgaataatgaagagattaaatattctagaaatacctaaactagaaaaaaaaaattatgtatcacattgttcataggctccttgttatacaaagataaggaaagagatattgtacacaaccttactcttgtatatgcaaataaactttttacatattcaaactcatgaccaacaaatcactaaagcataactatactaagatttaaaaaattaattaaggattaaaaactaaaatttaattttttttaaaggacttaaattaaataaaacaaatttttattgactaaaattgaaagatgataattttttaggaactaaaatttaaatttcaaaaatttctaaagacacatgataccatgtgactaaacatgttagtatcacccacatgggtgtcacatgattacatcatgtgtgttgtgacatgtaattttgttggacatataagtatttgatagtttttatttaatgtgggagactaaacttacttaaaaaatagagactaactttggataaagaaaattgagagaattaaaaatggaattctgaaatagatgaatgatgaaaacttatttaaccttaccatagattgtgtatactctgtttttatttttgtgagtagaaggcgatgtgtttaaattttgtttcacggtgccttacctaatgccaatatgacaaaacaaaatagtaccacttgttttttttatctaatcaacacaaaacattgaaacaagatgtagaaaaaacacaacagacctcgagaattgaacaagatttagaagaaatacaaaaaaccttaggaattgaactggatgtaaaaacaacattgataggcacaactgaattcaagggcagttattgatgttacaatcagttagtcacacagctccacagcatatacttgaccgactttcactcattctttctcgtagctgtcattggataaaaggaaatgatttgctatatgcttgctaccttcaagtttaatgaccttttgtacaatcctttcgataaattcatgttggtacctacaaaagtgcaaggtcttttaagaattcatccgctgtgttcactttatttctcctaatcagactttatgtcattaaaacaacaatattaagctcgactaattaatcttctcactaacagattgccgtacaaaatacaaaaactgctccaaacaaaacaacacacaataccccatgtctcggacaagaactatgccatgtttagcatttcatagatggtcaatatcacttaagagggaagcatatattaagtaactaattaaaagcattacgtactcattttctttgacatggtctccttccaaattgttgatttcagacaaagcagaactccatttctgcaccttctcagagtcctttccaaatcttttttcatgttcagtcatggcttcaccataactttttgtttgattgcatacatccgacttttgcacattgtaaaatattggccaaaccatttgattgttggtcttcgtacgctcaatgatcttggcaagttcatcaagacaccacgtggaatatgcatagttttcagaaagcacaacaattgaaatccttgaactttcaattgctcccataagcttctgtgatatttggttcccactctccaattcctcatcgtccatgaagactttgaatccctctcggcgaaaggcattatagagaaaacctgtgaaagtgtagcgggtatcctctccggtaaaactcagaaaaacatcatatccgggcaaggcttgcacggctgattccacgatcctttcgatgaattcatattcatactggtacctcctataaaagcacaagtctttttaattcaccaggggtattcgagcatggacaaccatattgtttctattaatcagaattagttgacttaagcttgactaatctatatgtatgcacagaacagattgctactgctacactgaaactggaaacagaacctttaatttacagcacacatgtatttctctcggttaaacaaaacaaagtgactttctaaaacgataattagaagatcagacatactgttcagcagattacagatacaataagtaataaagaagtggtgccatgctatgctagcagttgtagagattaataatggaacttaatcaactaaaattaagcatacccagtttggtaacaccatccattcaagttggtgacttcaaataaagctgctctccattgcttcaccctctcattggaatctctaaatatttcttctaatttagacatagatgctccatagttaccgccctggtgccttacttgccacggatacactccgtaaaagatgggccacaccagttggtttatcgtcctgttacactcaaggatggccacaagttcatcaagacatcttgaggaggatgcatagttttccgagaaaacaaccatcgaaatccctgattccttgattgcttcaagagtagagtgtggaatttggctgtcatgagtgtgtagtttacgatcatattcatgttctgtgaaaaaggtcttgattctcttgctgcgcaaagcattatagagagtaccagtgaaggtgtaacgggaatcttcgccatgaaaactgagaaaaacatcgtagtttttgagttcattcgacatgatggatgagaagtagcagaaggtggcttgcttgtctcgttgactcctcctaatggccaatgcctccctacttctctttctctctttcataaatttaaaatattaacacgatgccctacgcggttttgcttaatttccttgctgcgccccacttcaatgtcaagctgaaataaaatacatgaacatgggttgactggaccagatggatggatggagtttttgttttcttctccattttcttatcaacaaaccagtcatgtcattactataatctccatttaaaaaaaaaatacacaaaatttgtaaaaaaaattatcaatgacaagatttgtaattaagtatttaatctaaacccttaatttaatttaatagttgtaataattaagttcttatttataatagttgtaataaacagaaatccaaaagttttttttttcaaaccaaaaaagctcccgttgatagttcttgtttctcataaataattgaaattctgtccatatccttttatcgttgtcttaattccaaaaacgcagtctaagcaacgggagaacactcaagtttcttccacgcctatacaatgcaacggaataagtacgactgtacgagaccataaactcggcccatttccacaaaacatttgatctgacatttctatagacttcattggggtctctaactaacagggggcaaagacaccattttggtgctagtttttttcctgtaaacgattcagattttgaagtacaactattatgaatatctcctaataatatttaatatcgtgtttggtacacacaaggatgtcctttagtcccattttttttagttaaaataaataaaagcagtaaattgattcttatgtatacgtttcttgaaagagatgacagaaaaaaattgggagatcaaaattttttgttaacagaactcctaaaatgtttcaggaattgctctcttttcactagtttttgctgtcacaaaatgtccagctgaattacgcatatcctatgagtgcatggaatttaacaatttcaaagccagagcttcttgctcctccaacgtaaccgcaccggtagttataccagcattccctgaaacttcatttctttcaccctcgtcactgtcactatcaaagtatattttactctttttatgccgtctatcaacagtctcatctacttctgacccagatatatcatcttggtcgtcctcttccgcattcccagccttccatttcaacttctgcttgattcttttttctctaagccgctgacgctctataagcttgtcttccttgtcagccttcttcaaatcatctcgcatccttctatagtattcagctttttgttctgcatcaagacataaagatgatgtggcaaaatgtacaaatagcccatgcttatgaagtaagaacatacatgtaagttagctacttcaatgctctgaagaccaaaatggtatatagtgatctgatgagaatgagatctagccaggttctcaaattcaatgatgattgcagaaaatacaaaagggttttctaattggtaaacaagtgtgtagctataatttaacattttaaaacattttttattattttcacaaaactatgaaaacaaggaaagaaatgacacgtatacacatgtacaagcaacaatttcaccttcagcttcagtttgcagttgaaaagtatggaatacctggatcgagcagcatttctttgccactttgtgtgtcagctatcctggctagtggaggaagtgtgtggccgtcatcatcaaatacaaccctagtcccaagtggcctgtgtacattaatcttgagtttctttttcttcaatacacgagttgctggtctgcataggaaagaactaaattggtaagaataataatggaggaagaaattcaaagctccagatgaatggctcccgccaagaaatatgaaagatccaactttatacccaacactaagtttgaattttttttctattagccacatcataaggtgttatattcaaatatcaatttgtctcagcaattttgaaaccagaagactagtgtagcccctttccataatcatatataaaaaaactaatgcagcattatcagaaagcagcctaattttttaatctgtactactgtaaaaatgtatatgggaacgtacattatttcttcaatttcagatgacttaatttcaccttcatttgcagtatccgctaactgaagaatatcattttcggtttcctcatccttgaaagcaactgtgtctagcttcttcctggaaatctcaaagatagtttccttgtctgaatcctctggctcaactaaagttgatttagttgtcacatatttagatttaattttctggtttagaaaacggattttgggggtcattggtaaacctaatgatgctgaatactcgtcaataggtagtttcataacatcaaatatgtctttatccttttggatatggatggatctcaaatatgtgatgaatgccctctgagcccgatgctgcatgtctgggtatttggccagtaaagatgccaacaaactagaaactggttgcagtagttcttgccttggctgaataatcaacaattgcaaaaacatggaaagcaaatgtcagacaaacataagactgaagtgaagcagatttaaaagtgacaccttgatgttcaaatgaaaattggaattgcatgcatactattaatttgcagggaaaatgtaccttattaaaatgcactggaacctttgctgcttttaacttttccagcatttgaatttctgaaggcaacagaaataaaactgactttccatcagatttatatcgagcagtacgaccaactctatgtatgtaagaagctacattttcaggacaatccacctacaaatgcgagagaagtgagagactgaacataaaaacaagctttttgcttccaacaccccaccacaaagccctaaaacttgctccaagacaggaaaccaaaagcaggatgagactcacctgaacaacccagtcaactgccttattaaaatcaaggcctcttgcggccacatcagttgagaagagaacagagcgcttctcacaaaactcagaatatattgccattcttctttcctgtttcatcctcccgtgaaggcacttcaatggtatgccagggtgcagtttcttaaatgcttcaaagacaaattttacctattaagcagggatgtgaacattatggaagatagtcaagctcaaaagagggaatttgcaccaaaaaccacatcttaaacattttccctgtttacatgaaagaattatggaaaaattcatcctaaaaatcctttaaaaattttctcattacaataaccataaccagcacaactgaaaaccataacagaagttctacgcatgtgaacttcatcatgtagctacaaataaaacaaaacaattatttacttggccattgaatatgaaactaatgagacaactttcaagtttcaatcataaaatcaaactacattccctccaattgcacaaaaaatcttgaaaatgatgactagccagtagccatgcattggctaagcatcaaagggtgcaacttttcaagtggcatgacagtaaaattgtaatagaaacctataacatacaattcccttcaacaagaaaaagaatttcttgaaacaggacagaaaagtggagttggagttacctgcttacagcttgaaagaaagacaagtgttttcgactgtagatgtgtctttatgaaactccacaacatatctaacttattttccaggggaacaatcatcacaatttgcttcaacagagtaggagtggaagtcacagattcttcgtgcacactcagatactctggatccttcaaacttagtcttgcaagatcttgaattgactttgtttgagttgcagagaaaagcaaggtttgtctacgctttggtagttgggaaatgattgcatttagttccttcttgaacccactgtctagaatccgatcagcctcatctagtaccaaaacctatatccgggaagtccacccaaccatcagctatattgatcaaatctaatgatacatatctgttttctggtttgacccaaataaacacgtactttggaagacaaaataaaaaatttatgctttacaagggcctaaagcatataaaaattaaacggcacctatactctgcttcaaccactgttgctaaatcacctaggcatggaagcaaatttttttgaaggttgttaaggctaggaaatcttgacatacccaagtacaattaaaaacagacacgaggaaacagatagtgatataaaacaaacaacttaattgtaactctaatttcagagtcagattgaggttaatctatcacatataagaaaaaaagttatattaacctgcatctgtgaacaatcaaaattgggagtttcatccatgtgttgcagcagtctaccgggcgtgcaaatcaatatgttgagctcatttacacgttctttctccatgtcaacgtcctttcgaccaccaatgagaaggccagcactaaaattatggtgtttgccaacaaccttcaacacatcaaataactgaccagccaattctcttgtaggcgatatgatgatgctgccaacaccatcttcaggtccccatctctctctatacaacttttccaacacctatcattcaaaattcaccataaacaaataacaataagcacaaatactacaattcaatataccatctattcacccactacatattaaatcaatgaccttgcccaaacacgtatcagcttctcatggctttgaactttcgatgttgattttccacacttattagtaaaatgttatgattatattattatcataatatttgcattcagaaaccacgataaacaaataataacaagcataaacatcacaattcaatatatcatattctatttactatacattttctcactttgagctaatcttgtgattatattattatcataatatttgtattagttaaataaaaagaaatacaggggaccctaatccgaagagaatggagctgagaaatgaagcacttacagggataatgaaagcgagggttttaccggagccagttttggcggcgccgaggatgtcgcggccacagagcgcgtggggaagagacgctctctggatgtcggtcatggccacgaacttggactctcttagggcgtccttggttttcttcgagagtggaaattgatcaaagcgtgacgcgccggcgtagcgcgagtaggtgttatcttcgaggcggccaacgggggagtttttggggagacgcggcagcgacattgggttcgaaccggagtccggtggctgaaactggatccatgaattcaagaggcttatctcttcctcctctgaaactcgctgttgcttgcgaaactccttcgatttcggccttctcattgctgtagcttgaaaacgaaggtgaaggtgaagatgaaaaggaaagttggggttaggtttatggtttgtgtgttgcgtgttgttgcggcagaaagagtttgcagtgcaggaattgttggcggttaaagcttcatttttgtgaacggcgatgagctacgtaatgggccgagtgatgaatgattgggctggtccgattaatccattgccattatttttgtacacctttttttttattttcctccatactagggaaaaactttatacacccagcaaaagactaatacatcactccaacttttttaaatggccaaagtaccctcgcgttatacaagcacggattcatgaatccgtaagattcttacggattcgtgaatccgtatgaaccttacggattcgttaatccgtaaataagttttttttttaagttgaaaaatatttttccaaataatgacacatgtaagtttcgaacatttaaccttcaggttattaacacgacgcttcaaccaaatgagctaataggtcaattatactaaaagctaattaatgtttatacatataacattaaattttttaatgtatatttaacacacgtataagtttacataataaaatttgtaacaattaattttgatataataattaaagtattttttacatataaaaatcatagatttaaataaaaatcataagtttaataaaaatttgcaagtttaataaactataaatacagatataatttttaatttaacctgtaaatacaaatataatttttattagtcctgcaaatttttattaaaattatgatttttatttaaaactatgatttttatatgtaaaaaatactttaattattaaatcaaaattaattgttacaaaatttattatgtaaacttatacgtgtattaaatatacattaaaaaatttagtgttacatgtataacattaattggtctttagcataattggcctattagctcagttggttggagcgttacgttaataagagacctacatgtgccattattttaaattatttggaaaaatatattttaactttaaaaaaaaaaaaacttacttacggattggacaatccgtatggaccatacggatacaaatggtacttcgaacttggaacgagtatgaataaattaacgatacttctttaccttttgagttgttctgccggatcggtagcgcaagacctttggtctctacccggacctgatgaaaaaaatgggatcatatcttatggactcgttgagaataattctgatctagttcatggcctattagaagtagaaggcgctctggtgggatcctcacgtacagaaaaagattgcagtcagtttgataaggattgagtgacattgcttcttcggtctgaaccaaggaatcccttaaatatgattcaaaatggatcttattttatcgttgatcagagatttctctatgaaaaatatgaatcggagtttgaagaaggggagggagtcctcgacccacaacagatagaggaggattttttcaatcacattgtttgggctcctagaatatggcgcccttggggctttctatttgattgtattgaaaggcccaatgaattgggatttccctattgggccaggtcatttcgggacaagcggatcatttttgatgaagaacatgagcttcaagataatgattcagagttcttgcagggtggaaccatgcagtaccagacacgagatagatcttccaaagaacggggcttttttcgaataagccaattcatttgggacctcgcggattccgtatggcccatacggattgtccaatccgtatatctcaaaaaaaaaattatagattcgcaaatccgtaagaatcttacggattcacgaatccgtatgtatgaagtgtaataaaagtgagggtatttttagaaatgcactgttctggaatgatgtattagtctttttctgggtgtataaagtttttccctccatactattgtgattatgaatatgattcgccttatgtttcatacatgtctagaacttgtgaggttgaacacaatactccaattaaactaataaactaattatattaaaaatagttaatattgatatataacattaaattttttaatattatatataattttacataataaattttataataataaattttaatttaataattaaattataaattaattgtgttactcatataattttgataataattattagtggatgaaataaaagacaacaagaagaatcaacaactatctaacaaaggtagctaaagcggacaaaactctcatacttgacaaagagatgaagaagaaatttcatgtttagccaaaaccaatcagcatattgatgggcttctctaaaagtaatttgaatagtactgaattagaaaatatttaaaatggatccaatgataaaataacaaaatcataatattagatcacataaactttatctctaaaatggatttaactaggatacaaattactacaccgacaacagcgtttaccaaatttagggttaatttcggagtttgttttatttctttttcagtacaaagctattcattaaaaaaataaatgaggtaaaaaaacaacaacattgtcgatcagtcttgaataaactagaaagtgatatataaagtagaggttaactaaatttttaattcttaaattttagtttttaactctgaataaaagtgatatatagagtagcaggtagtgtgaaataggaatatatgtattgatcttgtgatactcttcgagtatgttccgttattatctatgtatgttgtttattcgagtttgatgtgggtacaccttgtgctctattccagtctttctattaatggattatctttgcctagcaaaaaaaatgaataatattggtctcaactctcaactcatgcaaagtgtattcaaatgtgaaaaaacacacattgcataagatgtcttggcataaatggatattaatgagtagattaacatccgatccaagtgaggttataaatgaccaattttttatgagtagggttaggtaagacattagagagatttttttttatgtaaacactctggttgcatgagtgatacatatataagttgcatgagtgatacatatataagaacgtagttttgattgaaaatgatacataagttattataaatcttttatacatattttttaattttcgtaaataaaaaagataaataaaatacttgcaatataagtttagctagcatactttatgtatgttattctttttttaaaatgtccatagtattattctttgctattattaattaaccaatttaaattagccataacaagatttgaacattactcaaacccttcactaattattttactccaatcaatttttatttttacttatcaataacttttttactagtactgaatttcaattatttaattctaatattgaaacttcattataagtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatagtgtgaaaattaaatttttatttgtttttatatgataatttaaaagctttttgttacaaaattacaataaatgactacaaacaacgatactaacatgtttgttaaaaaaaatatgttagttaaaattttaaaaaagataacaatgaaattaccctatcataattatacatcttttaaaattttagttcttggtcgtatatatataaaaagtatttctctgagttcaaatataatataaaagttcccccaaatcagaaaaaaaataaaataaaataaaagttacccagcccacactccaatatacaagcatgtatagtatttatatttatattgaatacttctaggtctgattctttggattttaaaataatttataaaaattaaaattaatgaagtgcattgaatctgcattggaagatttccttttgtttgatttatgctaaatgagtatacttaaaaagaaaattgccttctagaaagggaccaaaacaaaccatcatacaataaacaaacaattcaaacacgtcatataataaggacacactttatgtacatgtgcatggctacttattaaatacctaatgaacccacaatggagaaagagaagaaagaatggcgtccgaaaaggagtcgtttgcaagggcttccaatgccgaatggatggaagaagatgaggaggagcttcaaatggctgcattgctgaggttgccgacacatgccaacacagcgctgtctttggatatgagcaacagaggtggctcagggaagaagaaggccaaggttttggagcagattgatgtgaggaagctgagccgcttgaacgcctcgtcaaggatgctttgacaaccaatgaacaagacaattacaagctcctctctaccatcaaggaacgctacgagagttaaatatttttacaaaaaaaaataacaattctcatatcgattacatgcatgaaagggtttatatatgattttgcatttaaattatttgtgtggttgactgcaaaagggttggattggatgtaccaagtatcgaagtgagatacagaaacttgacaattagagcttatgttcatataggttcaagatctctgccaactttgattaattacatgcgagatgtctttgaggttcatacctattactcactctcatactaacttactaattaatcaaattaatttttagtaaaaatattgattatgggttatgtgtaataacattagttcaataatattgtctgtactctagctcaataattcgttatgttttcttatagataattaatatagccctggatctcccgccattgctttatatgcttttggcatgtttggatcaacttctctagaagtatttctaaaagaaaaaatgagatgatttttttataaacaaaaataagttcttcattagttaatttttaaaagctcaccaataggtcgaccttaaagacattccttgaccatcttgaataatatcagctgtgttgtcaaactataatattcttctgttattttacattatttattgagtaaactatcaatttgatccttgaaatactactctctccttaatggttgataaaataagaaaaactaagtaatctcttaaatattgaaagacttttcaaattaagccttaaactttattgaaatgcatcaacttaagaactaattaaactgatgaatatcctatacttcaaggattgcttgaacaattttattactttagggacaattaaggagaggataatagtttgggaacaaaattggtgatttattaaattccattcataattgatatttacgatatgaaatgcaaaagtatgtcattgcttgctacaatttttaacttcaattagtgcctttgttcaaagctatatttcacattacaagtggaaataattaacttcatcttaaaaacagaagaaaaaaaatagagggactgaatttggaccctctttctttgtatgatacactaaagaggtaattcagttagatcgattaacttaagcacatatcactacaagagccaaatttcaaagaaaattgtaacaaattcctagaaaggggagagagatcacctgtcgtaactctccaatcttaggagtcaaaaacaaaattctaaatgaaatctccttaaatcctatcaaagctatatttcacattaacttcatcttaaaaaaacagaaggaaaaaaatagagagactgaatttggaccctctttctttgtatgatacactaaagaggtaatccagttagattaacttgagcacatatcactacaagagccaaatttcaaagaaaattgtaacaaattcctagaaaggggagagagatcacctgttgtaactctccttttttggccaccagagaccccccttagcatatcattgcctacaaccatatctgaacatacatcaagaccaagcactttcaaaacataatctgtctcgacattgtggtttttgccaccaacaagtgttgcctgttgagtaaaatcagtttaaaaaaaacacaaattagaggacttccctgaacttgcatatatgcatgatttttcagatattatttataagatgagacaaccttcatgaatgcatcaatttctggacttggcagtatgtttttctccttctccaagcgttcaatatttttcacaatattagaccaggaaattaagtaactgaattctgaaatggaaaataaaaataactaaaaatggcgcataacgaaactaatatattatatacatacctacatcacttgaaccttggcatctgttagcaaaatcaaaagtttgtctcactgtcagttctgacatgtgattatcagtttggctagtgtatgcagaagccctttgaatacagaactcctattggaatttttaaaggttatgcatcaattggcaatttttccattccatttaaaaatactttgcatgttttctcattccattgaggaataaaatattcctaaatctttcagcttccttcagtaatatagttgcttgctatattccctcactgactgttatatcatgcttgctgcagatgttgttgagacctattgtttcacaacttgttgtagatccaccagctctgttggatgacagcatgaatatactaagtgtgaaggaagttgatgacctactggttgtgtgcatcggtcaaatggcagtgactggtggatctgaccttttgtggaaacctttgaatcatgaggtgaattttatgatttctattcttttctactactcgttaatgattgggcaagtaatttgatactgacatactggtaacttactggcttcactatcttgtttttcattgagggaaaatgcatatgatcgttgtcctcgggaaacactgttatgaatatgactggttctactattctccctattagtttgggtgcatggatgccccaagacattttaacaatagattaagaatatgtctaacaatagaagtaattaactctctaaaggccataataaaagtgtaaattacagatatggccccccaaaacttttaatttaacgaatccactcctcttacatgtaaacattcagtcagtagctgtgatgcagcagcaagccaacaaggtggacggggcaaatgggctcctagcaatgccagcaggttcaaatgtggactttccaacattagtcattcaaactagaaaaacgagcaaatccttaccaaaacttcctttgctagacctccatttttggcattgctaacaactacttatcaacatcacctaagcatagtaaaatcatgtcctatttgggaaaactcaacaagaacttctaagagaataaaataagtaggtaaaatggattgagtttcttaagttaaaattaacgtgtgcacaagttaaaacaagtttttagagaacctaaatcagaacttctataaaagttgattttaacttatgagagaagcttaattcattttaagctcttttttttttccttattctgtaagtgcttattgaatagtttatctgaacagggtttcagtcatgttagagttgaccttttctgctatgtttatcgggctttataaggtttaattgtaaatagactgtagcttttatgtcattttgatcaaactttagtaataatgtcaattgacgctttgtatccctgcggttttgacctaccctaccggccaatgatctttaaagatctgaacttgcttctgtactcttgcatccccatttcataatacgttagctttggtcctttgtagtcatccatgcctcacttatgtgttgaagtgtttagcccattagtttgttgttatagttttgggtattcagtaatatgtatagctcttgaatgctatatgtttgttccctgcaaatactagtattccttagcaactgaatatatttctgccttctttatccggttttttgcaggttttgatgcagacacggagtgaaaaattgctagctaaaatattgggcctcagaattgttaaatatgttgtggagaactagaaagaagaatatctagtgttcatagctgaaacaatccccttccttggcgaactgattgaggatgtggagctttcagttaaatctcttgttcaggaaactctaatattgaaacttcattataatattgaaacttcattatactagtactgaatttcaattatttaattctaatattgaaacttcattataagtactcatgattgaagtcatgaacttgagtgttaagaataaaaaaacagagtctgtcctcttttatttgtttttatatgataaatgctatgataattttcacactaatgatatgataaatgctagatagtgtgaaaattaaacttttatttgtttttatatgataatttaaaagctttttgttacaaaattacagtaaatgactacaaacaacgatactaattaacatgtttgttaaaaaaaatatatgttgttaaaattttaaaaaagataacaatgaaattaccctctattataagtatacatctttattgaaaataattatagtatacatctttattgaaaataattatacaattatattaaaaaaatattttttttaaaaagtttataaacaattaaaagttttatttaaaatgattgtattaaataaccttgtataaaaggaataagattatcgaccctcattacatatataaagggaagaagaccatgccaacaactatttatttatacaagttataataaagtgtatccctcaatcaagtgatacaagttcgaatcatgactttgtgtatgaaataaacaattgcaaatagaaataatcaccttatatgcactcacaataacatattaacattagtcattacttccatgaaaattattccatataatttcatgatcaacacaaaaaatacacatagaaatgaagtaatagttgtgtcaacccaacaatccaacggtctttagtgagtggtcgttgagttttgaaaagcaataaattttgttgtaattttttttggatggattgattttcaaaagtttgagttctaaaaaacaaattgattcagttataatttattatcataattgaaaaaaattaagaagtgaatgtcaaatcatttgcattgagtatcttaactgtgataatattgagtatcttaattgtgataataaggctgttcatgccagacaaagtcttgatgctttcatgcaacccacaaattataaagacacatgcatgtttaatttccatcatttgaaataaaaatcaattttaatgtggaactaatagataattttataaaaataattatttattaaatatttatttgttaaaagttgaatatttaaatgattaaagtattataaaaatagtctccctgtgataattttattacaagttttaattaaaaaaaaagtattttttatcaatattacaacataaagagaaattaagatatcaatcacaagatacaattgaaagttgtttgtaattgaaaaaatgtttgcaacaaagttttatcgtgttatacatttaattgtattttatgataattaatgttagaaatttaaaagaacaaaaataaaggtgggaagtaatagatatgaaaatattgatatgaatgtatgaccaaaaaataaaaacatgaataaatcatgatagtgtacaagagataggtgtaagattaaaaaaagtgtcaacaaattttctaagactagaatcggaaattaatgtttgggagaccaaaacgtggaggaaattttttcattaatctcatgttaaattcttttataagcgaataattttatattcttatcagatctctttttagagacttgaggtattttcttaattgggattccaatgtttatttttatcaccaatttttacataacacacataacataaataaactcaaattactaaaaaaaaaatatttgaccattgaaaaaaaaaatgtgatgacaacagtaaaagatgaaaaatgtcataaataataagtgaaaaaatgtgatgggaacatgagaagaaagataagagaaatatcattattaatattgaaaccgtgtttaaaaataacaacaataaatataattaattttatatatttaccccagttaaactgattattgtcaaatttgttcgttgacgatagcttgtgttttccattacaaatgttttgtacgagggatagggatggtattatcatggcttgagcgagtgcggtgtggcgattttgtctctctgccattacaacttaattatgcagcctccaactgcttctacatttcaccattcatctttctctcgaagccctcttcaccaaaatcaggtttcttccattttctctcaatattccttttggcttatctcattttactctctctcggagtttcttttttcatttcaaagcatttcctcagtttcagaacttttttacttcattcaaagcatttattgttacattatatcattgttttctattgctttccatgatgcagaaataaagttttcattttgatgtgtatgtttccaactttttcttttttgtagtaatagcgccgtgtgaaatgtgaagcttatgtttgtgggccagctttgtgtgaagtttttgacttttgggttgttgttggtgacgtagaaagggtgaattggattgaattagttgtttgtagtttgggggaaggacacagtaaattaaaatgagtggagtggggattgatattggaaatgagaactgtgtgattgctgcagtgaagcaacgtgtgattgatgttttgttgaatgatgaatccaaacgtgaaacccctggtgtggtgtgctttggagagaagcaacggtttatagggtcagctggtgctgtttctgctatgatgcaccctaagtccacaatatctcaagtgaagagactaataggcaggagatttgcggaccctgatgttcagaatgatttaaaattgctccccgttgaaacttcggaaggcccggatggtggcattctgattcgcttgaaatacttgaaggagactcgcacgttttccccggttcaaatagtagcaatgctctttgctcacttgaaggctatagctgaaaaggattttgggaccgcagtttctgactgcgttattggggttccatcatactttaccaacttacagagacaaacatatctcgacgcagcagcaattattgggttaaagcctttgaggttgatccatgattgcactgcaactggtcttagttatggagtttgcaaaacagattttcccaatgcagctcctatttatgttgcatttgttgacataggtcattgtgatactcaggtctctattgcagcatttcaggctggtcaaatgaagatactttcacatgcttttgacagtagcttaggagggagagactttgatgaggttctgtttagtcattttgcagcaagatttaaggaacagtacagcattgacgtgtattctaatgccagggcatgtaggaggctgcgtgtagcatgtgagaagttgaagaaggttttgagtgcaaatgcagtggctgatctgagcattgagtgtttgatggatgaaaaagatgttaagggctttatcaagagggaagaatttgagaatttggcatcaggattattggagaaatttaatattccctgctacaaagcattggctgatgccggcatgacagtagaaaagattaattctgttgagttagttggttcaggttcacggattccagctataactaatttattaacttctctatttaagagagaactgagccgcacgctgaatgcaagtgagtgtgtagcacgtggttgtgctctccagtgtgcaatgctcagtcctattttccatgtcaaagaatatgaggtttgaatattgaaaaaaacacattgattcttatcctatctatatgatatgtatatataggagagtagatttttgtgtttgtagattcttaggttagaaatgtaataattactaaatgaacaaagttgttacataagtgctaggtttattttctgcatttaatttgtctatcttaattgaaatatatctaacttcatagatatcattaatcatgtgtttttttttttatagaattttgcattagcatgtattactctctataaaattaatgtaatttcctgtgtttgttcagatccaggattctattcctttttccattggactttcatgtgatggaagtccaatttgtgaaggattggatggtgtactcttcccaaaaggccaacccattccaagtgttaaaattctaacatttcagtgcagtaatttgctccgtctggaagcattctatgctaatccagatgaattaccacctgggacatctccgaaaatcagttgcttcacagtatgcctgctttagaactttactatgatgtgaaggagtttagatcatcttgtccgtgattctttgttattaattttttattaattattaccctctctattcttgcttctttggggtgcttcatgaaaggcatgtggtatagtctctatgagcttattcatcttcttcattttactgttttggtatgtttaattctacagaaaaaaatagtatatactatatagtaatcatcatcataattgcagcttttactcttgaattgtaagtctaggactcagttatgtataaagctattacttgttatacatgtgcttgtattttatcatagtttcaactgtggattttttattcaatggttataaatgcactttattctttagaatgcattccctcactttagaggagtcaaatccaagacctgcaatgttgtttgaagttcaatgttgagtggtaaaaactcaacaaggaataaagctcaatattgccaactcaagaatgttatgatggataagtagacacacaaggtagaattaggaatgattccttagaaagttaggcaccatttgttgtagaaaatatggtagaatcgtgccttaagtggtttagacacatgtgaagacttgtagaagccctaaataaagagagtgaattagatggaagatagttcaataattagaggtagtaagagacgaagaaaaactataagttaaatcattaagaaagattaagatttaaatggtttgtttagacattatttatgataagacattatggtgtttttgatccatgtagccaaccccaccttctggtaaaaggctattgttgttgaatcttgggacaatgcaatagacacctccccctttcttgaaggagcgaaagacttcattattaaatggccttgctgaccatcgcttgttctgatctcaaaggaagtcattgctgtaaaagtgttaggtatagcaatatgagaatctgtaggtgtgcacatgcttgaacaaatcataatgttaggagaagcagatatggtggatctaacaccatccatatatctactgtctaagtttctcaaatggagagaaatgactgtatttaatatttagtatcttcaatgacaattggctaacatttgctaatgtctattctatattataagacatctcaatattacaggacaatgaagttataataattggttgtgagatactgccattccttgtgccagtgattaaaaagtgttatgtatgcttatgcctacaccttgtttttgtatgcttatgcatttgtttgtcatttctattcagattgatcctttccttggatcccatggaagtaaggcgagaattaaagttcgagttcaactaaatttgcatggcattatcagtattgaatcagctacagtaagaaacctcaattttatctcttcatatcgcattattagttttctgagagatctttctatgcacatggacatttttgtctttcagttgatcgaggatcatgtgaatgattcagttacaacaggtgattatcattcaaattctgaagcaatgaatgttgaacctgtttctgagacagttgaaaatgtcccagaagattgtatcaataaaaagtgtgaagctccacatcattcagtaagtactcccatgttgttctctctctctcccctgctcacctttttttactggaagatatctcagatattagagatttctagcaaattgtccttttaacacgaacaattatatggctaaattttaattatctgattatttctgatactgaatctgtaccatgtctttgactgtcagtctgtcgcaaccgttttttataatgtctgtgatgttgtatatgtacatttttatcttgtggagattgttttgattgcagatatgattcatgttggtgttttgagaaaataaaagtgttactatcatgccttgttacaggctgatggtacaaaaaaaggtaaagccaacagaaggcttcatgtacctgtgagtgaaaaaatttatggtagaatgaccaaggctgagatattggaagctcaagaaaaagaactccagttcgccgatcaggacagaataattgagctgaccaaagacaagaagaattcgttggagtcttatatttatgaaacgaggagtaaggtacatattcaatatcttaatgagatgtagacatgactggcttctctgattcaattacattgtataagcggtcacacatttcttctgctaaaatagataattgttcattgtatgatcctttttttcttctttttcatatctttactgtgaggtgttccttcttcaaaaactagagccttaaattttgccatgtaaatatgaaagtattgaatatatcaaaatgagaaaaagctgttgtatatagtcattgaagacttgatttttaatgacttctgtcatgactcaagtaaatgtaagggtaaaactttgtgaagctggggatggtctgctgttatactttgtaataacatctgcataggatataccgatatagaattaaaatctgaatccttatgccttttcttaccgttgattttattaaagctgtattcatgtgtatgctctacttttcattctgtactggtatttaaatttatttgcatgtatgaatagctattcagcacatatctaagcttttcaagcgaacatgagaggaaggacatatctaggagcctgaaagcgactgaggattggctttatgatgatggtgatgacgaaactgtagatgtttattctgcaaaactagaagatctaaaacaggttacttttgtttctccaatctccatgtttcatccgccatacttcttgcttataatctccatcttctgcagctggtagatccaattgactttcggtataaagacacagaagcaagaccacaagctacaagagatttgttaagttgcattgtagagtatcgaatgtctgtagattctcttccaccccaagataaagaacaggtacgacaataaactagtgaataagtataattgtgggatgtttcccttagtatcagtttttaagtgacaactttctttttcagatcatcaatgagtgcaataaagcagagcagtggttaagagagacgaggcaacagcaagatctttaccctaagaactttgatccagtattattgtcaagtgatatcaagagcaagacagaagatttaaacttgtatgattttaactttctgttttccttttcagagatgcataattgtagggtactatgatcattcatttgggtcagaattatacccctttctgaagcaaagcattgttcatttgctccaattttactcgattgtcattatatacattgattttatctcaaaaactaatgaatgttctattttcatggattttcagagtatgccaacagatattgaaatccaagggttctccacttccaaaagaaaagggtgaagacaagcagaatacttctaatcatcaatgaagacgatgaatgaactgaaggcctaaatttttaatagcttctgacaaacgtgaacttttttttaacacttttccccgtccggggagttgaaagagataacttcaaatacagtgaaatcattggtaattaccggttcaatctgctttttatatatatatatatatatatatatatatatatatatatatatatttcatttttggccccacgttctactaaagccatccaataagttagtacgtagacaaccaatcaagtagtttattttttgtcaagggttgctagattttatgctcgtcaacaagttttcaatttaattccaaattgtattcaatctatcattttggatgaaataaaatcgtgaagattggacgcttctgcgaaactgaccacctttatggctttatctttattcgctattaacaaaagcaattttgttatcctttttattaaaaaattaaaaggttacaaggattttggaaaattaaattccttttctatttttctagtgaaaaatcctaatttttgaatctgtacacgtatgctaatctcacgtatgtcctaatttaagtttccgctcacaaatattatgtcctaatttaagtttacatcgtctgtaaacttcagtatttatttggtacatgtgcattaaacatcaacaaatgaagccaataaacagcataagcaacaaaaatagcccaaacaattcaggcgaagcatctctatcctccgctcaagatagacggaataaaaggtcttcttgatgtcttcatttacttaaaatttgctatcatttctatcgttccattactttaatctacaaacaccagaagtaaattatgcataattgacatagcaacaagctatcataataacacagaaccaagtggtgaatcaagatggaatcgaagcattattgggaatcctaataaaaaaaagtgaaacattatctaaagttacaatttcatgatggccaaagacattaggtccttgtgcactgtacagaactacttgcataagctcacaatatctacttgccaggattttttagaatcaaatcttcactaagcaacaagaccccaattcagtttcctcgtgcgatgctgcatgctggatggctggcttccttgtccgcatccaacacatgataccggaagtttagggcaatttaacagcattgaacctatagggtattgctagtcataagatccacaagtaaattatgggatgtggaccaggcggataataaatttcttgccatcaagtgttcagtttctcttcttggcatttgtcgtcttggtaccttttttctttcttgatttcttgaatcctgctccactctcctgtaaacatcaaaggcattcagtgctacatcacaaccaaaaggacaacaaaacatcagaatggtatgcaagtatatgtaccttccgatattgtctataagcattgcggcctgtcaactcctccccacttttgttgacataaacctgcaaggggggataaagaatcaggttctgatagatttatacaatatgacaaaatagacttaaaagcttttctcaattatggttctggtcctataatttcaaaaccactaggaattggtccctgccattaaacatcaagtaggaattggtccctatataacaattaatcttaatgtcaaaagaatgtttacaaaaacaatgggagattgagtatcactatctagtgttacatagttatattggaatgatgggatcgtgtgcatcaaatcatagaacaatatttccaaaaaaaagaggcattatgtaatgtgataatttgaatttcattgcacttatttaaatcttaagtaacatactgtatgggttttttgcatttcagttttaaacaacagcaaaacagctcgcataacttcttatgaccagcatctaacatgagaaaagtaaataaatttaaccagttaatacttaataacattaaaaaaaaataaagattttttctcatacttttcttccttctggtgatgtaaaccaatgaccagcagattcaccacttgcttgaacacgccttttgcctgcatcctttggcaaactggtgcagctcctgggttccacccagcccccagaagcacatgattggttcgcagggtttgatttgtttgctttactattactttttgagacactattcttagtgccattcctctttgttgctttctttctagaagattccccatggctgaatggagaaacaattttgggatccacccagcctccagaagcatcaaaagatccctcaacattcaaattacttgatttgtttttcccccttgttgagctattaataaaaccattttgaactccctgcatgtttgaagctcctccattaccaaattgtcccctgaaatcaaaatacaccaaaacaatatgtaatacaaaatgacaatcactttctttttaaatcattaccataagattaaaacaacaaatgaacatgggttacgacttacatgtaatcaatgtgtgagaaattaggttgctgattcactgtgttgatggtacctagtggattaaaattccgcaggcgactgcggactaactgccgaattctcggatcctcatggaaaaaataagtatgagcgggatgaacagggtctgttgattcacatcgttgttgatccctctggcagctagaactaaccccaggattcctctcattaaaacttttagacgaatcaccacccacttccttgcaattggcagaacgaaagtactcttcacatatctcattgaaggcaggcgtcgggacagaaacattcttcaccggcaaaaaatccttccatagatcatcagcaggcgatgttttcttattttgttctaaatggcggttagggttagctttattggcaccagcaatatcaacatcaacatctgaatcatcagaatctgaaagcaactgaaatttacaaacagaaacattcttcaccggcaaaaattccttccacagatcctcatttccattcacatcaaccgaagttttattatcttgttccaaacgactgttagtgttaactttattggcaccaccgacatcaacatccgagtcatcagaatctgaaagcaattgaaacctattaacagaaacattcttcaccggcgaaaaattcttccacagatcctcatttttgttctcgtcagcagatgttttcttctcttgttccaaatgactgttagggttaactttattggcatcaccagcaccaacaccaacatcagcatcatcggtgtccgaatcaatcaattgaaaccttcggagaggactagtggttaacttgggaaacatcaagccactcttccctgtctctaacctggcagaagccggaacatcattggaaagtacctttcttttcctatccctgaaagagttgctacacgaatgaggggtcaaaaccccacttccattcaacgaaactttcgagctgctacacacagaatgattccgattccatgccgatggaaccgcatgccctaataatattacaacagataaataataaggaaattattaatattattatttaaaattgaaaagccgagagagaggtgaaatatttgaagtgttagctaacctgaccttgatcgggatcttcttgagaggagaactcctcgatgtcgtcgtcggcgtaggcatcggcatcggggtcgagatacggcggcgggggcccgcgacggaggcgtttgaggagggggcgcggcgggtcgggtcgggattcgggatcggagtcggagacatgaagatcgggagaaagaggtggatggattggggaatgggggggcgtatcgtcgagacctagggaaaatgagggcacttcgaaattcgccatggaaattgaattgagatgtgtgtatgtaatgtatataaaggagggtttaggggatttgaatttgggggggaaatggagggaattgaaatttctggttcgcgggtgcgcgactgaaccatcttcaactctttttttctgtcttctttttttatatgacagaatcaagatttacataactcactttgttgaatcaactgtaagtttctttttttcatttacaataaagttcttttttattctgattttattgcttttgctggaaaaatgttgtgaacgtgataaaagtaatttttttttcttcagattttatttaatatttagcttattaatttattcaggataaaaggcattatttttattgttattataattataaaaataaccacaaacataataaaaaattaagtcaataacagtcaaactatctttgtagatcaccacatttttatgtttttcagatggtataatgtatttaaatattaatttgttatatcaattaatttcaataaacattaaataaaatcaaaatggaagaatatgattataatttgaagaaaatttaagtgattaaattaacacaattaaaatttaaatgaccaaactacacaattatgataccaaaaaaactaattaaatatcttaaattataacatttttacataatcttttaaaatcataattcattacattctttaagaatgcaattaaatcttctttttttcctctaaaaatatattcttttaaaaaacnnnnnnnnnnnnnnnnnnnnnnnnnnnnnnnnnnnnnnnnnnnnnnnnnnnnnnnnnnnnnnnnnnnnnnnataaacatgaggatacatgtatttaattaccatgataaaatttaataactttataattaattattatataaaaaattcattcacacctattaaagtgaaaaagattcattctgatttattcacaaattaacattcacaaaaaacttttatatccaaaaattatttttattattttcctctaaaattaaacacatcataattaaaacttttaaaggtagaaagctttccttctcgtgtaacatcataaaattaaaacattccttacgttaattatcacctcgacttaattattatcagcaaacaaaggaaaaatgctaatttcaatttcattgtttttttttatactttgacaacattaactatcaaaatgaacaataaaggagacaaacagaaagaggaaaaggtccagtaagtattaagttatatttttttgtcccggaaccacaaatcatccttgccacctcctaaaatacaatctacaagaaatcctaagcaacatacacaatgatagaaaatcaaaatcttgagtagataatgctatcatctatattatatgacgattttttttcccatcacatttgtcctctgaacataattgataaagtacaacacatgctacatgcttctcataattttctcaagaccctacccaatgaagaagggcctgtaatcacagatgacaaagcgagctatttcccaagatatcccagattttgaggaatttagcacaagggaatgagaagattatctgcttttaaagcttaatatgaatgataatgaagaactgaaataaaaactagcatgaggcagaaaatgtgcatctattcatgacccctcatcactgtgagcagatttttccataaagcagcatatttgtaccctcacaatctaaaatgaactgcttttcatcaatcatttatcaattttacaggttggcaatctgtgcaatgcctatgcctaaaactaaatcttctgtttaagaacatggcgcaactgaaccttctggctttccattctggcctccataagtctggctttcaaactattcttctgtgcagtgcgaggaatgcatcccttcatgccttgatgtgcatgtggacttcctgactcgggactcaactggtatagaaggtcttggggactcagcccacctttacctgatccatgatcaggagacatgatgacaccattagataacattccatttgaaagtctcccatttattccctccaaagagattatcttgtaattgtccccattgtttgagtatgttgacctccaaagcttcgttatggatgataccttttttgcttgcttcgttggtatagagcacacttcacttatttcagttattggtgtctcctcacctgcagtttcttcccattcaagtacacttctccctgagacgttactctctcggtgattcctgttcaaagatcggctactcccttctggtgaataacttgagccttgatcgtcgacatggctcacagtctcccatccactttcatctccttctatatccccattatcatccataaatacatcagaacgcctctgaatgccacctttacttattgcattggcttcaggactcaccatgtcaatattcgaggcatgactagcaggactgtgagaaacacatggttcaatctccctcttatttacttcaccaaaatttgcatcttcaaaaatggcaaaaatgtcatcagagttagggggttcatatgaaaatcccttaatgtcttgaatgttcattgcagctgcagcctgttgaagtgactgtgcctctttcatgtccattgtgttcggctctgtgctttttgacctgatatagctttccaaatctgcaacgagtctattcatctgtgcatacttctcttcaagagcaactttagcatctatcaacttcatttgaactcgttcttcacgccatacttctgccatctgtaacatcttgctctcctcttccacttcttccctgagtttcatagattccctcttcaatgcttcaacttcagccttgtcttctccaatttccttggcaagctcatcacacacttcctcgatcaattctctggccttcctttccttctcataatcctgcatgtagcgctttgcagagagtttgacatctgccaactcattaaccaacctcgaattgacaatttcaatcctctggcgatttttcctttctcgattcaactctgctttaatgtcatcaatgtatgcgcggattttctcatgctctttgcttctccattgggccctttcctcactgactttcttcagaaaatgctcaagcttctttttggaggagcggtgttcagtctcaagttcctgaattcgtgtttgtgcctgctctagttcagctccgagagccgacacaacagatacagcacttgccttttggtcaagatgtttcatgtggctgttgatatgctgcgcttcctctgatgtttttgaacataaaggattccattttgttgcaccctccatttcattgttgggaagctggaaacgttcaggctgaatagcataaagtaggtttaaaattagcactttaattgtctgctctttcacttttagtgtagaagcagaacactttttaaaactcttttgctcatagacattggaaaagctaatttcaccatgtaggtttacatgaaaaatgttttatctaagccatctctatactgttatacatagcatgggtcaatacaacaatgagcataatttgtttcaaagttcaaattgggtggtatcaacccataatatgcatgtgtttgcatgggcaggcctttgaaatattactaaaaatttccacaatatgaaatcataaacaacacgttgctatgattatagtttgtcactatctataacttaataattagatgattgatgtcattttcacaaagatgattaaaacaggtaattgcatgactgagcaatgggatattgggatcattgtgcagtacaggttgcagttttaacttgagttattatgtgtatatgacattcagtcaataatcttcaattacaataccaaagagctgtaaaactcctaatggttatattatattgatattgaagtagtaagaaaaatcatacctcacagaagtgtccattctttgtcccaaatatggaacggggactttgagatggattcttcttcagatcagaaccatgggtcatgccattaggatgaccgagaaactggagccctgcgtgaccaattccattctgcagataagtgtcatcagtgatcagtaatgagaaatggaaacctatgaaattaatattgtaaaccagctacattgatctacaaacgaagacaataataaagtgcatggaagataatcattctctaattcaactggaatgtacagagaacaaataacagaatctcatataaaacgaagactcaactaaagtcccaacttactctcaaaaagcacaaaactgacaaaagaatatgagttcatataagccaatattattacacagcatgtttgtttgacattctgccaaacaagacgcaatattcaatgcactctggatggatatgatttaatgcagcacgaacggaagcaactgattcttcctttctccgaacacaagtttgcgtttagggaagaaatcttcaacataacaataattatttacaaagacaaaccctactcaactcatttctccaatcattacaaagactaataattagtcctccaccagaaccacatcactcgcgagaaaactaaaaaaacaaaagcatttgtatcttcaaaaggcagctatttttaatttcatagaaagcctaatcggctaatccctaactctaacaccaaaacaggaaagtgaacaataatgacaaggaaccaaggatagaatctgaacacccacgattcaaaatcaagcaacaacaaaatcatcatataaaaataaataaaccccaacaataaactattaattcttttttctccatgaggggtggcctacaatacagtagatgaagtaacctagtagcatgtagctgcaaaatcacatttaaatcaaaaacaacaaacacatgcaagatgcaacaacacgcacacgggaacgaagaaaaactagggatcccaaacaacagaaagaaagaaaaaaacaaaagggtaaacgtttgagatcccacagtgaccagtgtcatagacaaaacagtgtatataagcagagcaaaaccctcgcagcaaaaactaggttttgcgacttaggtccagacccagagtgtaagaagagtagcccaagttatgttccaacctaccttatgttccaaccccttccggccatcacccgtggccgtctccggcagatgcaaccgccacagcccggcggctagtctcctcgccgactcggcgacttcggcttgcttcttggcgctccggcacgttctccggcgggacccagcgacggaagacttctggtcgtcttcgagtggatcgtaatggatcttccacttcaaaagaggggtttcgggtctgctccgtttgccaccgtgtctcctcaaccgtgtccccggagtcctcggattccgccgcagaaatggcttcgccggttcaagatctgagtcaggcgaagggttgttcacgctcctcgaagcaatgcccgccggaaaactccccttgccggaaaacttcatcgtcgccggcgagtctcagccatttaatcaaacaaacaagagttacttgcgagaatgaatggcccaaagagataaaatggaaacagagtgtgtgtgtgtgtgtgtgtgtgtgtgtgagagagagagagagagagagaggagatagaatctgtgtgttgttggagtgatggagttcgtgaagtgtgtgtgtgtgagagagaggacacgaggaaagtacagaagagagagagggagggagagtttcactgtttcagagattttgctgagaaaaagacgagcacagtgacaatacaaatacacatacgcaaagaggtgtacgtctttccgtatgtttatacggtcaacgtatctgctatcagttatcatgattccacgcgcggggaaatgttatacgatgtcgtttggccctacttgatttataagctacgatgtttgttaaggctgctggtggaagagacgttctgatttgaatgatctaaggatggtgggggggtttcttttacattttatttattaggatttatttcaaggacaatgacgttaaaatattaattaatttatatgtgaaaaaagatattttaagatgaattcaagaaagatttattttatttaaataatgaaatatatattattttaaaaaattggatcaatttacatttcaaatcaattttattcatttttattttttattgtttattactttcaaacataattataagattttagagttcacacccttttaattgttccttattaatttttttgtgtgaattaggatatttttaattgttttctatcaactaaattaatatttgttaacagataatttcatttaagttaacaatatttttaatataatatagagaaaataatatttgtttacataatatagaaaatcagatatataatatctaaatgagtaaatgtcaagggagtaattgtaaattctcctgacattttctattgatagggatgacaaaaatacagtatctaaattaatcattaaaaaaaattgattttaccatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttgtataaaataaatatttattttatacaatgcaggtactaattaaaatattagttataaaataaaatatagacttagattggtaaaatttgaataaaacgaaatgatacttaaattttcattagaaatatttaatttaaattttaaattaacctaattgaataaaatgatgatgaaaagtgattcaacgttgtgaagcaaagaaaaaagttaaaaaaaaaagaaaaaaaactaaacccaattttacttattgctcatttagtcaaattgaaatgtatattatttactttgaaataatccaaacattgcaaaaaatgataaggtttaaaattacaacctctaaaaaaagtttaaaattacaagttcgtattacttaaaaaagaggtggatttgttcatttatttcatatcatagagattcgatttactgttattctcgtagacaatgagtatataattaatgaagcaatcaaacatttatgtcatcgtcagttttggccattggccaaatcagaaaataaaaacatctaacaggaatcaatgaaattagaaacaaaaactattagaaatccaaatttgaaagaaaaaatcctgttgattttttttcatttttccctgcaagtctgaaaattgaaatataacactatggtatcgtcgcctataaaataaaataaattgaaatataagagatcagtgataataattgttcaagcatccagaaaagaaaagggtacaattttccatgcccggcgtctacagtgggaaagtaaggtaggtttcccactgtgcgtaagtaactgtgattttgagatatatgatagacaagcatatattagattttttttttttttttacataatgactcttcttcttcattagcatcatcgtcgacctctatttgtcgtcgttggagatgatttctcacaacatcatttttttttcctactttcagtttttcatttccctttcttttcttacgctctccttctccaaccactgagcgcagatccgaagtgaaatctaaatatgaaccaaacctcaaacattaatccaaagcaaaaaatcaatcgtacaaaaaaacacactttcattcatgaaaacccccaaattcaagcgaaatttgagactctttcgtggataggccaaccccagatccgcgacaactagcatgcgtcatcgacgccaggtcgaagatcagtgcacgcaatcaaaaggcgtaaacttagaaggattaatctcccatttagatctcattgttggaattaactggaaaaagggatggggaaccaaaggtgtagtggacaacggatgacgacacctttttgtaccttccttcacaaaagttccaagcgatgtgttggagtacgatgtggttgacaacactggtggcgttgttgacgatgaaaatcttgtcgacgtggtccttgaagatggttgagattggaggaaaattgttctaatgtgtgtaaacctatgataatcccaaacatacctaaaaagcatatagatctaatggacagtaattctttcccacggtttaggtctccaacgttagacatcgccctcgaaccaaatgcatataactaaaaaaaattagatgttcaaaatattcttctttatgcaaagataggaagagaaattttgtaagcagttttacttttgttaaacagattgtttttgaatttttctttatgcaaagagaggaattatataagcaattttattcttgtatacccaaaaaagttattttcaaatttaaattcataatcaaaacaattttattggtgtgtgtagtgttattgaaatctgattggatcggtcggtctgaccggttgaatcggaaaacgatccaattttgtcattaaattgattatgcagtcgacttgatcaaacttgatcgatcggattagatcagtttaattttttatgtacttttttgagatgtgtttttttagattttggattattatcaatagttattttaaatttttgagtatgaataacttttttttactcaaataatattaattatatatttatatataataaatatatataattttaaatttttaatatatattaatttaaatcaatttaattattaatctattaattaaatcattaaactattaattcactatttcgactagatgaataatcgaatcagttttcctaacgagactcacttcaataaaatgcatatgtacttcaataaaatgcatatgtttatttgaaaattgatcacgcgcgaggagtcggtcgtgtagggcacttcatagcaaagcaagtgtcgtcagtgtctgatctatttgttgcttgcacacttcaatatctactctgtttcgccctagacaaaaaggcatccgagggagactccacgtggcaaccaaagagactgtcacgtcgataaatacaaaacgtgcgctccaatgctccatattaaaaaaatacgctttcacatgggcttcgaaattgattaatactatttattttaatgagccaaccctctataaagtggcataataagtgataactttatttttttctttgtttggtacgacttcaatgcagaattagatctggatagcttattaaaattaaaaatcttaaagtaaacaactggaaaaatggttaatggctgcgcatcctaacttgattttcattttcattgccattgttaggtttccttttttctctttaaccatcattggattgtaagctattatatgaagggttttaacttttaattcaagtaatgctaagtaaattaagaaaatacgtacaaccaattggatataaattcttttaaattttttcaaaggtgcatgcaaagccgaagtgccaaccaaattcacagaatgtgtgaggttctacttggctcgtcgctcttgtggggcattaccatcatgggtccaaatttaatttatacgtgattctttaccattttattttttacttttctatctggagcatgtgtaatttaaattttcgttctaaattatgagctaggttggacttcctcagaaataaaatgtttgttgaatagattttaaaatgcatatatttattacttactgtgtgaatgctattattttctaaatgtttattttgttgtttgatttagtttgattcgtttcaataaatatatgaaattaacagtaatattcctttaatgaatttttttccctttgatagaagattatttttcttcgctaaagatgtgatcttaggaagatattttaaatatttataaaaatggagtatttatttttatttccgttattatctttcatttatttgtataaatatgtgaatgaaataagacaggttaagatctttttgtttcccctcatcacgggtaatattctttgatgtttatcacaaactcataaacttattaattaagtattctctagatcttaatcttactctccaaaaaagtattctctttatctttaattaatattaatagtttttttttacgtaacctgagtagttgtcttgaacaataaaattaattgatgtaaacataaaatcgttcaagtgctttgctatataaacttttaggttattgttgctttaattttatcgaacaacatagacatttttttcgattattatattatatgaaaatatataatgtgaaaaataccagttgatgcaggatcacgatgtacatatattgtctacatgcatggaaaattggaaataacaagagcccacgttcagtggggacttcatgtccataatcagcattgataaaataatagactatgtacgtgtcaggactcacgtgcaatgatgaaataatcttttcgtagaaagatagattatatttatataattaagaaaatactacataattatactatttttttcagcatatggtaaaaatgaatgtgaaagaaaaaaaaatatattatagaaattattttagaagttttttttatgaataatataattctaaaagaaatgataattaccgatagttataattttgttcagcaaaaaaaaaaatgaatatgaatatttatttttcttcaataaaatattttcatatatacagtcaaaattacccaaatgaatatgaatattgtatatgatcaaattccgaccagaaaaggccacgttggcaattaacaaattatcttttacgcagctttttcgttttttttttcaccaccttttactcttgaaaataatctgataaaacttatgcataatacagtactagtaaatataattagacaaattagtaatgtctaagatgtggtggaacattcagatttccaaacatactcttaatcttaatctttagtaatggttaatgtttttgtttaatttaagtacttttgtacctaatataagattctttaattaattcacaataattagataagttagttaatttaattagtcatgttaaatttgttaatagtttgtaatttttttttaaattactcttaaaattaccaaaagcataatcttattcttttcacttaatttctatttaattattaatatctttagtcatattttccaattctcgcaagagaaaaatatttttttcttattactttgtaccatttattgttaattaagtacaaaaattgtaaaataattaaaattaatttgataaaaaaataatgcaaagacaatttaaaagagatcttaaaaagagataaacaaaattttcaagagtgtatacagatatgaaaataataattaactaacaaaaatcttatacatcatgtaaatatttataattatagatttttttatattagaattgtatttttaaaaattataatatttttttttactttttacaatatactttactttatgttaaggtttatgtgtgtttatatatatatatatatatatatatatattatacctaataatatattttatatatagtattttatatattatatattattttttatactagatacacgtattatgatgtcatgttattttctaactcagtttctttcaaaagataaaaattacgctaaattaacaggatagattaaacaaaaagacaacataatcatatccggccaatacatcaaaaaattaattacaattaaatatgatcgttattttattctatcctactttaaccaccaaattccctaacctcccaagtcccaccacaatgaagtttgcctttttcataagatcacgttctaatgtttcaaagaaagaaagaaaaaacgagacaataaaaaactaaaactacttcgttgaaagaaacaaattatacattagtaatttctataatttgaagaaattaatctctaactaaaaggatacgttcagttgttaaccccccaaccccacttcaaaaataaaaaatgtcgtgttactaatcaagaaataaatttatataagggaacgtaatgaaatagacaatgctatcagtttctttcaaaagaaaagttttgaaagaaactgacagaagagagattatggcagaaaagaaagacacctgatatatagttcataagaatggggagaaaattatttaaaatggtcaaataaaattaagttaaaagataatttagtctacctaatgtaaaagttgtccagtccttcaaatctctccaattttgagtgaacaattttaactaccttctccaaaattttggatcaaacaaataaaaaattataataatacttatcttccattcccccttctatttctcaccaacggaacactaactaaaggtcgtggagataatatttcaaagcaaagccatattatatataaaagacaatatacaactctatggctatgtccatcttcaacctcaaatacagtgtgcacaagctttgttgatatattaacaaatacttactaacaaaactatggactttcaatatctgaagaaccggttgcattaatctttgaaggcaattcacttatggcaattaaccatagcaccgaattggatcattgcagcctttagaagcagattgcttgaaaccaaatcggccacctttctcaaggtactgctgatggtactcctctgccctgtagaacttcttggcaggaaggatctcagtaacaatcttcctgttcaactgcttctcctgttgctccaatgactccttggccgccttctcttgttccggcgtgtagtagtatattccagatctgtactgtgttcccacatcattcccctgccacacaacaagatcaaatggtaactaagcgcttaagcggtagaatgtacaatccatgtatgtgctgctgcatatcataactagtcaccatattttcaaaagtttgtgtgtgcatggatttggatggaagagtgaattcaacaaacaaaattattaagtatgcatattgaaaggggagaacaaaagaaacaagggacaagacaaaaatgtagcaaaggaaatactgaaatagattttctatttggagcaggtgtaattttaaattttcgttctaaattatgagctaggttggacttcctcagaaataaaatgtttgttgaatagattttaaaatgcatatatttattacttactgtgaatgctattattttctaaatgtttattttgttgtttgatttagtttgattcgtttcaataaatatatgaaattaacagtaatattcctttaatgaatttttttccctttgatagaagattatttttcttcgctaaagatgtgatcttaggaagatattttaaatatttataaaaatggaatatttatttttatttccgttattatctttcatttatttgtataaatatgtgaatgaaataagacaggttaagatctttttgtttcccctcatcacgggtaatattctttgatgtttatcacaaactcaaaaacttattaattaagtattctctttatcttactctcaaaagaagtattctctttatctttaattaacattaatagtttttttttacgtaacctgagtagttgttttgaacaataaaattaattgatgtaaacataaaatcgttcaagtgctttgctatataaacttttaggttattgttgctttaattttatcgaacaatatagacatttttttggattgttatattatagtaatatgaaaatatataatgtgaaaaataccatgttgatgcaggatcacgattttgtacatatatatattgtctacatgcatggaaaaattggaaataacaagagcccacgttcagtggggacttcatgtccataatcagcattgataaaataataaactatgtacgtgtcaggactcacttgcaatgatgaaatattattttcgttagaaagatagattatatttatataattaagaaaatactacatagttatactattttttttttcagcatatggtaaaaatgaatgtgaaagaagaaaaaatatattatagaaattattttagaagttgtttttatgaataatataattctaaaagaaatgataattaccgatagttataattttgttcagcaaaaaaaaatgaatatgaatatttatttttcttcaataaaatattttcatatatacagtcaaaattacccaaatgaatatgaatattttcaaaagtttgtgtgtgcatggatttggatggaagagtgaattcaacaaacaaaattattaagtatgcatattgaaaggggagaacaaaagaaacaagggacaagacaaaaatgtagcaaaggaaatactgaaatagattactccatatggaaacttatttttggatgctcacaagtcattcaagagagccatatataattgaagtccaacataagaagttggaactagtacattaccacactgaaattaaagcaaaatcatcattgcaattaactcctaaatgcaactgataaatggagttacagaatgtacaaagaaaggagacaatccatcggatgttaagatattggatcaatgataatcataggagctggggttcattgcaggttcttttgaaaacagtgctcataagaagagatgttttaataagagagattttgctgacaagaggaaaaaagaaataaatggatggattggatatcttacccatgaaacattattaatggatgggttgggatttttctttatcatataaagtcatggatggtttggatttttttttttaataaaattctaccacatcataaatgaactaatggtttatttttgaacaatctattttaatccaacttaatttatccaaaccatctattacattacacccctataaacatcccactaagtgcaaacagaagggtaaaaacaacctaaacaactattaccaagagacccctgcaatttgatgcgacccaaaattcaacacaatatcatattaaaacagaatttacaaaacagacatgactagatatcaaaccataaatgtatctgttaaataatggctacatagacaaaaccaaaattactaatttactataaagaaatcaatcaaggaatcaaaaatcaatcaaggaatcaaaaaactgttggcaaaatgtttaactctagaagtaatgcatcattaaacaattgtacagaaaccccaaaagtaacaaaaatcatttatgctgacaatacacaaagtccagacctattattcatatcagaaaaatctagaaatatcaattagaaaccagacttcctcattttttacatgataccgtgaataaccaaaaaaaaaaaaaaaaaaacttcatatatacctgtctattcagagtggtgggatcatgtctagcccagaacacgtcaagcagagtctcatagctacaactttttggatcatattgaatccttacaacctcggagtggtttgtggtccctgtacacacatcctcataggttggattatgcacaagcccctgggtgtaaccaacctctgtcttggtcacaccaggcaccctctggaaggccaactcaacaccccaaaaacagccagcaccaaactcagcaaactgctggcctggtgctggtatgtcatcatctggaccctgaggaatggatgaatccatgttctctggtgctcttgcgctgccaaacccaagtctgttcaacaggttcatggagggcttgttcacggcaatgcgaggacgagtttgggaaaggaagcacggacgcttgacagaaaatctagaaagtgagggcaggaacttggttttggcaggacaggagagggaagaggaagcaaacactaaaagcaaattggacgtggtggtgtagctgctgctgattgctgctaaacatttgaataacatgagagtccttttctagatgaaataatcaacttcaaaatgctcttgtatatatgaaaaaaacaaaagagccaccaaatcaggatgccaagacaactgaagttacaaatttgaacagataatcggaagtttaaaaattaattttgaatcactcatccatatggtgctacatttattactataccacatggcacttgtatattggtaaatggtaatgataaaagttttacatgaatcaaggatcatctgaactaataaaataattattctctgttttcattttgaattctcacatataattacaaaaatatcatcttatgcttactttgttccctattgtcaaggatttgtgctaggaccaaccaaaataatttgtagaacatggaaaatagtaaacaaagtaaatgtaagataagatttttatatttatttatgaaaataaaaattgaatacatatattttctgaaaccaaacacgtcctaaattttataaagataattaggtttaaaaataacttaaactcccatcccatcacatcactttatgttctagtcctaatcacatctattcctccctctaacttttggatattttttcttatagtatatgtgttttctcccccaaacatggactacaactttacaagctgcagactcacatacaactgtgcctactattgaacactaatttaacacttaaacacgccactattttttattcaaataaaacaattagccgatactctttctttcatgcatgtatgcaatcagacaggaatagagaaaaacaaatccttgttatgaaatatagaagtgatttatggtttaactattagcactcacttgggggaagaaaaagaagacaagtagtatagtataagattccaatttcatagaatttccaataaattgaaatccatattgggtcaaagattgtgccaataaataaaattatattttctcatgcaaacagctggcccagtgtgcatccattgctattcataaattgggaattggaacagaatcacataaaaataaaaccaaactcacaagacccagaattgggtgcataaacatgaaggaaataagtccaccaaataaattaaaggaaatccaatatcaacccatacctgctccacaaattctcatcttcaacccttcaacaaattacaggaatcaatctccacacaataataaaggtaatttttttaacactaagaagaaaaattgaactgaaataaggagaacccacaattcccttttcctcacaggttaaaaggaagagggaaatgggagaaattgaattgagaaatgagagaaaacgtgcaattggagaatgaagaacacaacaatacgtaccccaagtgactgagtgagagagtgagagcagaagagagagaggttgctggttgaggattgagagaagatgaggatttgatcactgcaaaaagagcgaccgttggagctgaacaatcatgctttatcagtttatctctctacgctggcatcaatcccgaaaatacttaaaagcccctacccaacttaccaccaccctttaaagtgtaaagggtagggacgtcatttcccaatcaaaatcacattaaaccccatcaccttcgtgttggagtttgcctggaatgtaacgcctagaatattacaaaaaaatagtgcatctaagggtgacacgtcatgaaatatggttcatgtattattttttcacgattttagagagatgatgtataaagtaaaaaaagtgcaaatttcaaattatttactttttattaaattaaaatatctcacaatttatcaaaaaaggcatgaatcaactggccttgataatataaaatttagtgttatattttttttaatatatatgtactaaagattattttttaaaataaaataaatcaagttaatttataaaaattgtttcatttattttttataaatactttttaattaatatataagttaattttaacttataaaaattgattcaatttatatttatatttttataaatatttattaaaatttttattcaaacaaaagcttaacctcttaatagggaataaatcccattagaaatgcatattctgattgatatcttccaattaacacaaactaaaaagccccttttatctagtttgtgttccttttttttcttgctgctgttttatttttcatatatgtacatagaaaaaaacacgaaacttctttttagtacctttaaaaagaaaagtttgggtcactactttatgtaaacaatatcatttctagtgtgattatttctatttttatagctataggtttgcacttttatcttataggagaaccacaatgattatacaacaggggtccttataaactaattgttatacacttcttacttgatgtagcttgtaacttgttacatgagaacttaatttccgtttgggtatgtgtccttggatgtataaagaaaagtttttttttttttttttttacctgagtacattaaaagtcagagttnnaatgatgtaattaaaacaacttaatataatatatttattacgttgttatcagctttttacgagattttttgtgagtggtgtgattagctccttcgttttgttaatgttcttatcattttcttacgtatagttgcaacttttttacctattcaaactaacaaacaaatcaattcacagggcgtttgtttcactaattatttctttaattctgaaaatattttttcttgagaatatgacatagaaatattattcacaattattttaaaaaaatatattatatatctgataataattattttattacctcataataagtatgagaataatttttttcaatcttatattttcaaaaataaaaaataatccgtgaaataaatgcgttgtagtacatcgagctattgtttgtttagcatttaacaacgatctaaggattaagttttgaaaattttgaaaaaatggttaaatacagtaaaataggatttcgtaatttttcaagtttttacttatctagttgaaatgtgaaaaagttaagtttttttagaagtatattttatgaaggtttttttttaacctctcgccttaaattttgataaacaaaaagaactaaaattggattggcttatttatttataacttttttgtgaagagatagagacgggttatgtatctaataagaaaaagagactggggttgtaacattggtcttggactgtgccaaggcccatagtacgtaaactcaatcgtgtcgtgggctttttgtcttccaccagccgaccgtaaaatactctgggcttataagttcggctcagaattaagcccattagagtaaggaataagtgtagcctcaacctcaatggtctggtctgaagtgaactgaattataaaaaaaaaactcactgaactgattcaactcaaccgaataaaaaaaaggaattgagtctacactctacatattaagtaatgtctctccaagaataaaggataaaaaaaggaggtctttaattagtaggtgtcggcaaacaatttttaaaaacattttgtggtctttttttttatagaaaaagataggggcccacttaatgatatagagtcaaaagatgatcacttgataactgcaacatagcgattacactatgtagtagatagccactcaattctgtctttgtatgtatatatctttgaagaatattataacattcattttatattgaatttttgtcctatataacgggcattgccagtaatttttattttatctttttatatcaagcaatttcccaatgcaatttgtatgcatgtgtttaattcaaattttatttttctttttatataaaattgactttaaacttaatgttcaaaatgaaaactttgaaattaaaataaaaattatttcatatcttttatttcttttaatttaaaagaaatgataaaacaaaaaggagaagatagagtaagagaaaatgtaaaaagtgactcaaaattgttctttttttgtattgaaaatctacttttttccgaacatgattcttcagcacacattgattagtacattcagtttaatatgaatatatagaatggagatttttttttgggttctttaacccggccagttattcttgaaacaatcttcttgtgttgaattaattgggactcccaagtcctgtttatacaagagtaactaacattaatatgcaatgatgtaagttttggagtctcttaactatttttggtctgactaaaaaaagtttagatatggaccagagtagtttttttactctgtataatttatattactgcttagaaaagaaaaagaaaaaacaggtaatcaacattaatatgaatgtaatagattgactgtagtgtaaatttactgatctataaacaaaagtatctgactacaaattaatcctaaaaaactatatttacaaattaataatattaactaattacaatttctataaggcaatttctatatatttattattgtctcatttaaaaaaacaaaaatgtaaagctcattaacaaacataaaaaatcaacgggcgttagtatatatgtaatatttcccaataatattttgtctatcacttaatattaaaaacctttgacaacatttaaaaaatatagttaaattataaataaatattactaatatatttttgcgacattttatccaatattattaggtataacccatgttgttaaagtctaaaaatgttaaaaaagactttaacaattttgatataatgtgaaaaatattttaataatatttatttatgatttgacgataatttttaatgttactaaagatttgtagtaatgtttttattaataatgtttgataaaaaaaatgtcaatggaggctacatatgcagtagttgacatgttctgcagtccaacatgtatgacactcactcagatgtgacttatttaacttttataattcatattttcttatatgccatgcttaaaacataacgccgtttattactttgattattcaactttgatacacctaaacgtggaaagcagaaaattccaactacaacctattgtgcttttacaagtcctaattaattaaggccgttattgaaatagagtagtacatttgacgcagtagttgtaaaacgagcaatcaacatcagctacacgcggtgatttttaattaataatatttaaggaaaattaggtagctactagaaaccaattgttttcctttgattagttaattaccaacacaggtacacaactacatgcacaagtcttgggcaaaatactatgatattcatttaaaatttaaccctacaatgttgtcaaatgaaagccaagtaaaaacattaatattttagctagagtctgcagctaactgctgcttaattaagacttagaagtcaaacaaagggaagatagtagtcaacaatcgccaagctaaaagtcatatttgaattgaccatataatatataacaacaatgaaatggcccagaaaagaaattaagccattgggagattaagatagccatggcgcccaacatttgcatgcacacataaagtcatgagtggctgcacgtatttcatgggtgcagcacgtgatccagcattcgcgtttgtgcaagaatgattcaaggttttgatttttagaaatttacttatattttggataaagtttcttagaaatttataattttttaaaatgtatagttttttttttcaatcattatttagtgattaaacatatcaaactctaaaatatcaacatatataaatgcatgttacattatcaataattagagatagagatatatacttattacaattcgaaatcgtgctatgcaaatttgctttaactttaactatctaaaagccaaaaggttgactacaagctaacattcgcttttattcatattcaataagaggatagcacgtttgaaatggcaacgaaaagaatcttgggacacaacaacctagtttcatatttgttcttccccagctcaaggcaaaaactctgtaaggtggattttggaaatctatatgattttcttcgtactagtccagtttccatggagcacttgcaatgattttgacgattaagttagtatttgcaatcgtagataaagtgtgtaaatttatagagataattgtttacttgggactggaacatgttcttaggtttacttctaaaattattattgagttaggatggtgtctcttgcatgataacgcatgttaagtatctttaaggttaatcccttgatttgcagtaaggtattaataaattgtgttcatcatcttgtgcttttgtatttgcatgaattttatatgcgtaagaatatgatcgttgaatgagaggggcattgggctatgataaggccgatgagtattagtaaaattaattttaattaaatattaagttttttttatattataaatgcaagttagtagtgaaacttagtataaaagttatctactcaaaatcaattcatcaaaagtaaaattaaatatatataaaaatttacatgaaatcacgttaactgctatatattgaacatgattttaaaacatcccaagtgaaactaaacaaatactatatcattcaaaatctttaaacacattaaaaactcaatacatagatatacatatttttttcaaccatcgcactggcctattaaaaaattgagtttaatatattcttagtttttgcaaatataataagttttaatttaattctttaaaaacataactataactcctataatttttaatttttttaaaaataatccctatctcttttttttttaaaaaaaaggaagaagtaattacggtgttatgtagcgcatcgttgtagtccttctggcttctgatatatataacgcatcaagaatgtccttgagattgagaataggtctgagaggaacagaggaggtaaaaccgatcgattttgacagtgtgtatggaatccaaataaaaaataactctatataactaataattatggatttgactatgtcgttgtttaaatgaaaagcgttctttaacgatcgttgtttattattgatcatttttccacaagagtcgtgtagggagtatatataagctacatatataattagggttatgataatgaaaaaagtgtgtttgggtcagccaaatagaaattgcacgtgaaaggaaggtagccaaacagcaccttcactcaaagattccgttccctaatttgtgttcacacctgacgtggctacttctatttgaaacttgtcctcagattccaggtttacccttttcacacctaaaacctaccaactaattcagcttttattatcactttatgatcccaccatatattttgatgaagctatgtgtttttaagaacacatttgatcaaaatcatggaatataaaagtttaaccgcatacttaaatagctataatttatttgtataaaaaagacaactaggtttgtctcataacataaaaaggtattttccaataaatttatagtagcatctaatttcatataaagttataacacgagcttcttgatcatttgtcacaatttgaagggaaatgaaaatgagatttgtatcctgagtttaattatgtaataactatttttctacatactatacaaggagaaaaaaattatttggcaacaatttatcgttgttggaaatgcccagtttcgtttttgtctatttggaaatgcctttttaagtaattaaaaataatgaaaagaatatagataattcatttaaaaaagtttacgatagattcctaccatgcccatgttcacacctgaaacaatattgaattgaacatttcattgctggctgcatgacaaaaataataataatttaattggtgaactttgagggcttgacttgtgcttcgcggctgttcatggcttgcatgccactagcttgcttaaagatacacaatttataaacttaaatacaattctgtaattatttttaataaattattttatttcggaaatttaaataataaatatgttcattaaaaactaatataaattactgaaataaacctttaattttaattaaaaatatttatgaaattgtatctaaatttcgtcttatcagtatttatgcttcaatatattgttctacaatttttgactcattatttttttcagaaaatatctggtaattttactgtatatgcacccaaaaaagtcgcactacttggtacttgcttttcaggtataaaataatatattgaatagaaccttgagaagaaatcattgaatatattttttatctaaaccataaatatcttttattatagacaacaatgcttgagttagaaaaaatccttaattatagtaaagtgaaataaataacgtaattcatatcataaggtaatatttttatatttttcctttgataatagtgggcttgctttttttttattagaacacaactattttatacaaaatataatttcactcgagttaaatttaatataattgtgatttgaatgatttttttactagggaaaaatttaattgatgacaaaattatttctctaaagatttaactcaattatatatttaaatttaaactcgaaatgatctattaaattaaaatcatcctagctaataaaaatagtgttataaaagtcatatgaaaattaacctacgtccgtgagttactgtggatcacctggtattttagtacgattcttttagataaataaataaaaaaaaaaacattattggttcattcccattatttataaaacatatttgttgggatggcaaaagcaagtagagccgcgccagtcgaagtctaagcgtcggctcgaatatgatcccgtaacgtaagacacctttaacttgaagtccgttagagtcaaaggggcccacacttgccacctaggaaaacctacgtgacactacttaggtttgacctttcccattttctcatttaattttttcattacctatctctatatattggtaatatcatatcacccacttagctattactttccatcattgcaattcgcaaagccacacaaaacaaaatgggcaattgcttgaggcgcgaatcgcggattggatactccaccgacgaggacgaggacgaggactgggaggattttccggcggcggagagcggcggtgttaagaaaaggaggagagaggtgaagataaagataacgaagaagcagttggaggagttggttggcaaagtggaggtgaaggagttgagaatggaacaggttttggcgcacttgatgatcaatcactctcttcaacgtccatggaggcctgctcttcaaagcattccagaagatcattaacgtaattaattagatattggagcagtgtattgggcctattaattggctcaatccttccatcataaactagggttttggttttgttctgtgcttctaggggaatgttaatattgtaaccagggtgggtggttggatgggtgcttacactttttttctttcttttgtaaatacaaaactttagtacccttttgatgctataccctacatatatcactattagaggttgatttatctttatctgttatcttctttttacttttctcgtccttctcaatttctatttatattactaaactgatacaaaattatttcatcttgattattaatttttgagaaatagacttttgctatctgaatattgttgattgtttgtttgtctttctaatgtgttacttgatcaagagataataatccacaataaaacaatatatttttctaataagaattcgaattttgatttacttattgtgaagaatgattcttttgctagaccgaactccattggtatatagggatataaatttttgtgtggggttgagaaatgtgatgagattctgtaacatgtttttctatctgctccaccatacatattgtgtccagggtggccaccatttcattcttcaacttgagtggcgagtggcgtgaatgaatggttgtgagattcgctttcacaatttgttattagttttttagtctctataatagcagcattgaagttgacgagaaaaggagaattgtttttttaaggcttggtaagatcttcgaaaaggatgaaaaaattacaaatatttttttattttatttctgattgatgactaatcgacttggactattttaccatttttttctcctaaaagctgactcattatttttttacatattgtatgaagtaacgttaaacggtggattaattagggcccgcgagtaatttttattaaaaacaaaaatggatatttttttcaacaaacaatgggaagctatcactttcaagatacgttgcctaatattacccacatatggttcatctttgaattagtaaaacattatgacaatggatggcagtggtgtgaatagtacatgtatgggaattaaaacatggtagattaattgaatggggtgaagagaagcagtgcattggcaattttgaaatgagttgcactatttatttatcatacatgtcccacatgatggaaaaaaagattgatttggaaattggatctgaaagttggaccaagtacaagtcatggacccaacaccatgagactaaactgtgcaaatgctctagcctacaactaaggtttgtatcctttaatgctaagcttggagtagtaggtatgatgcctattcagcattacacactttctatatatttttctaaaatatggtgtaaaaccttccaaaattcctagggcaactaaatctctttgtcgtcactatcgaaatttggtggttgatcaatcatgaattaatgagagctttgtggatagaataacatctcaagttttgagttcacactgctcctatttcctaagtcctataatgtttgtattctagtctgccggcagtacttccaagtccaaacccaaaatattataacaacaaattactattcctcaactttaacataagtatcattttaagattatgtacaaaaatttaaaagtaattaaacactctttaattttaaaaataatttactcggattatattaccttttcattttataatattgtcttattttgcttaattaatagtatataaaaactacatatgatttaaagtatttttttttaaatgaattatttgctctctttttttaaagaatgacgaatgatttaaaataatttaaaactttgtgttggttatttgatataaaaagctccaaatgttatctgaaaaaaatttaacaaaaaaatctacactgcaaagatacttttatccaattcagtcaagttaggacagacattttttacataagaaaaaactacttacaggtaatctactagcataattttttaaaaattaaagccaatttatgcattttcacaggcaaaatttgactgaatgagtcttgttataatagctttgtttaaatttatgtcacatgttcaataaaaatgattttttaaggtgactatggcattggtgtaacgctaaaaatgtgattgaattaattttagtaattttattttataataaaatatcaaaaagatttatcctccctctcccgagtatcgctaaataacttctgaagaagtacttatatggctatatttgaataatgcttttatatacgttcactatagttattttcgattacaactattgacaattaataaattttgtattgaaacttattggatgtttatttatttaatgataaataatataccgatcaaaagaaattccataaggtattaaatattttgttgtactgcaatatattttttcattggttcgtatgacgttcatatgccatatagattgcctcatcatctttaaaagaacaccctgtatacgcacacgcacacaatacgtcacccactcgatctcaatgcttacaagatgaaaatctttctattggtaagtggtaacactaacaactacaatgatattagtatagtattgtaaacgagtaatgttcacttgacatgatataccatatcaatatcaccatcttgtaattgcttttcaaaataaaattgacttcccatcatcgtcgcccatgaatatgatattgatatatgttgcatttatcttcttgtattataaacgactgataggagtatatattcactgcaatttgcgaatggattatatcattattttattacaagaaaaatatcgacagatgtgtgtatataattaaaaaaaattcaaaattgaaacgtggttaaaaatttaaagtaataacactgacacaatgtgataatgaccttgttgcagagcttttgtagcatttgtattgggtacatgcattattgagcttcataaaaattacaatatttcagtacttgattttatttttttagcttatgatttcgcaataacaagtactgttttaggaagagggaggaacatcttcttatcgcctacaaaagtgggaatgtgggatgacttgttctcaaattgttttattttttacaaggaaattatgtatataaaaaaaaaaaaaaaaaaaaaaaaaaaaannnnnnnnnnnnnnnnnnnnnnnnnnnnnagagtttgactactcaacagagtcttagtcatgaatgtgtgggaaaagagtaaagagaaaaagtcatgatgggatttcaaggattaagtggtgctattgaaaggagaaaaccaaagttttcatcagagttatggaggaagaatgttaggaaacacaaggaaatgcaaatgatatgtgagcgaagatgggataaagggttggaaaaatagctaaaagacacttgaagaatcaagaggttggggacctgaggataaaacatcttggtgatgatggaatgtaagtgtataagataaagttaagattaaaatgaattgttttaaagcatgattcttgtgttagaatgctgaaaactagaaaatgtgtgatagttaagaaaagtaccaaaaaggaactgaagcaagaactaaaagcttttattcgattatgccaagccttagggatcaaaagtggagctagagctgctacactctacaggcttgctaaaattagagagaaaaagtcaagagatttggataaaaaaagaagtgcattaaggatgaagacaataaaatctttgtttttgttatggaacaaaagtacaagacacgatagaaagacagaaaaattacttttagaagttatttaattaagtacgtaaatttctatcaggttaaacacaagggacgaggaccaaaattatgccgtttattgtaagatttgggagaaatgtatcagttggcacatttctataaaaaaaaaaaaaataggttatgagtatgaggcccaagaaaatgccagaagagtgaagcagtgataacaccaaattgtaagaatattgatatgaaaaagattatgcaaattattggcgataaagatgaagttatgagaaaaaggttattgagggaagattaagaaaaaagactcatattactaaaacaatttagatttatgcctaggaggtaaactatggaagcaatataattgctatagcatttaatgaggagatatcgttggaataaaaaagattttcatatgttctttattgagttagaaaagacatatgatcaaatactaagaaagatattgtggagggccataaagaagaaagaaatttgtgttgcacatcttcaaacaatcaatgatatatatatgaggaagtcaagactagggtgagaacacaattacacagtggaatcacaacaaaatttcttataaccataggattgggccaagggttaattttgagctcttatctctaccttagtcttaaatgtccttataaagtgtatccgaaagtcaatacagtaatatatgctttttacatatgtagttctgttggaaaatccatagatgacataaatgaaaaattgagtatcttagatattcttttcttatataaatacaatgaactcacaacttaatttttcactgtttttattaataacaatacctattttctcccaacataaatcaacatttgaaattcatgattaacaataagcttgacggctagaacaagtatttgtaaatttgtttcgagagtcgttatatattatcgttaaaagggatatttatatatagtatcaaaagcattcaacactggccaaggttaaaatagtggcgttttatgtagttattggactaaaaattataaaaggaaaataagtgaaatacattaggtaaaaatctttacctggaagagaatataaaaataaaaaataaaaaatgactactaattagtttcttgatctagtctgccactagaggtgagtttcttataatcagtcattatggaacgaaatcaaggaactaatattacaacccaagttgccacaacaattctcatgcagaaattattcagttttattgctgcaacaaagcaactacctttcatcaatgatgttcattcaaatccacggagattacacatgaacttggtatctcattcaaatcaacagagagcatcatctatactcttggaagttaacatgaccagttgcttgtgcatgctccactgcctcctgaaatgttcacaaaaaaaaaagtactcagaatcattagaacaaaggagaataagctaaggtgggtaaatagaataaagcaaagcatcaggtactgagggatcaccttctgaccaattactccaatttggcatactccacagcgcagagtgaagttagaagtgtccgtgtaactccgtttcctgagaaagtgtagccatgatatattagcatcatgggcatagcataaataatgatactaagtagcagaaataattgggagaggccattcgagatgataaaaaaaaaaaaattacgtaccccattaccctaaggctccacgctatgcgcagatagatgatatcgaaattaaattgagaagattaaaaaaaattacatcatgcaagataaaacaaactgacttccctttgtattattgcagagttaaaatatatgttcctactggcagacaagatacatagcccaactatctctttcacttaaaaaatgtgcataatttcacctgtatttgtttgacaatagaaattggcaaagttgaagttttcaacttatcagtcgatgtatatatattaacagctttgcggcacattcaccatgttcttgttctaaattgataaaaggtgcactggatttgcaaaaatgtcttcttatgtttgcactaacaattacaaaaatgtcattagtttcactttattttttgtttttaaatatttgcacataaaaacatgaattgaggtgaattttgtaattattactgaaaacagaaaatatttccacaatccaattccaaattcaaatgcatcccaactcctctgaaagtgaaaccttaaaatacatgcccaaaaagaagaccttttaggtaccaatattcacaacaaatctgatacataaagaatccaaatatgaagatttatgtaattcaattatctaaatatgataatatttatctctttcttttaagaaggttcaataagaatagcgaactacctctgctggtccttcacaaaatttagaacaagcccttcaacaggtccaatgcttctgtttttctgtacagcaaatatggtctgatcaaactcctcaggagcttcctcaaagggagacatctgacccatacaaggggtgtgagtaatcatcaggcaacatgaaaacaaaaatacatatgaaccttaactttttaattttttttattgtttcatgtgtagtagataaatatagataccatatacttgtaatctcacaattcacctccaaaaccacaaaaaaaaatgcacagaagagaaggaatggatcaacatcaacatcaacaatacctttaacccaagctaattggcgtcggtgaagagaaggaatggatgataaaaaaaaaaaaaatccggtatatgaaattacttaccactaatgcatcatagtggagaccatcataaatcagcatcactctttcagaataattcctttcctgtaaaaagtattcacaaaaagtgaaaatagaaaagttcagtcataagaggttgcaaaacttgagagcatatagattgcataagagtgactaacctgaccgtacaaatcacatcgagttgtctggatatcatatgctgcaatttcacgtccataataatctgctaatattgaaagttcaattgcaccttcacaaagaaaaatagagcttaattagcacatcaaactaacaaaaagttaacagtgctttattgttaaatttgctagtaggagtttgaaataccctttgaaacccatgtcaaattcatcaactacaaaatctatacccaccaaatttatatcaaaagcctaattttagaaacaaaactgaaatttaaacaattgtcacagaagattctctgggtatccagatgtttaaataaaatttcccaaattttaattaaatctttatgcctctctgcgtttcaggaaaataatatattttactcgtatatactccataatatatttatcttagcaaagtttattaaaagctcagatgttaaatcaacctatatttgagtgagtctcatcaccttcaaagttccaaataaaaatgaattttccacacttgaggttacacattcatacactcaccacagtaacaccaaaagtagcagttccaatttgtagagtgaaaattggtaactatttccatctaactttttattaaaatagccttgattacgaaaaacataggtcaactaacctccccacttctccgagtcaagaatccagttacaatactctgtgtttggcttcccaagaaatgcttcacaatatttctgtggatcacttgctactgttgctgctataacctttagcatgtcaaatgacaaatagcacacaaatattaagtcaaaatatgtaagaaataatgaaataacatactcaaaatgcaaagatattaggcaatacaatggtataaaagttccacttgactggtaattcttaaatgataggcgtcatggcgtggcggattttttgccaaccaccataggcaattcgtgaagagaggcccactgtggcgtgtttacatggaggaattttacccttccgccatgttctaccaaccgccattgataacactactacgatatgtttcactagtccaaatcttgagtttattgtgtttgatacctcaagtttgaaaaatgatatttttctagtagaaaagatcatatatttaactttgaaatttttgttaaaatgtaggggctaaaaacatattaatctctatattttgtgggattaaaactgaatctcgatatattttgagggaccaaaaacatgttttactccaaaaataaaaacatatcttgaggcaaaagttgaccagccagaaatgaagcacccctggcactagaagcaaaatacacaaataaactgaatacaagaaaaaaaattacctgtctcaactcagcagctttctttttgtcatgatccataacatatctgaaacaattaagcaaaaccaaaaggaaggagaaagaacatcacaagtggaataatttgtacaagtagcagtaattccaaaaaaaaagggcctgtgttccattgcttagcttacccaacagcattgaaaaggcaactgttatccgaaggaatgacccttctcagaataacaccttccatgatgcagattgtagatgacttaccaacctaaaaatcaatcacagaagaaccatattcaaaatctaaaacacaataactaaagcaacaccgcatgtgtattctgaaaagaaagggaagaaacagaaaatggtttgaattggaaaatggagatctatgctatgagaattgaaaaagggattggtctgagaagaaggagagaatgaatacgaaccaagcttgttaggtgtgttggatttggtattggtatttgaataagaaacgttttcctttcctttttatgcgtcaaaagaattaacattaacttaacgggattgctaccgttttcgttcagatgtcaccgtcattttcttcgccatgccccactactctcttccatgccccacacctagcattcgcaacatcttccctattttattctctgttatccaaaactattattttctaaacaattttattgctatattcaccattttttctcatgattattttctcccgtctggggaaaattgtcatgtttagtggtcccaaatataattaatttcacattatttaattgattcttgatatttaattttaataaaaagtattttagaaagaaaaaaagtaaaatcgctgcaattgtttgtaactaatttttaattatcgataatcaattattttttaatatatttaagatagggggaataatctttattgaaaaaacagacttgcttagttatattaatataccccgtaaaaaaaaagatatagtaatatctcttcttccgatcaaatatgatattttcattcacaacatttattatatttgtaacttaaatgaatatacaaattttgcaaagtattttaaataaaagtaattttcatgtaaataattgaaagaaagataaaagaaaattaaaattattaaatatgtggatcaactgatatgagattatttcaatttaattaaaggttttggattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaagattatattaagaatttatattaatttacaatcaaatcctaagaatttatattaattgaattaaaagaaagttatctcaaataattaatttatcaactaatcttatcaaacactattattaagtcaattagcttataaactagaagcttataagctaattttaccaaaagatagtatttacactgtttaacttttataaaaagctattttatttagttcattcaaaattaaagttgaaaactataaatcgatttttacttacagaatataaatatgatttattttatttttatttcctgctgttataagtatggatagaaaattctatctaaatagtgtacaagttgacacggtagagttatgtaattatgagaaaggcaactttatgagtaactttaatgttcgtcacttaccttagtatttttttaaaaaataacatctatgtataattacggttacttaaaaaagtaacgttgcttaattaaaaaagcaaacgtcgttatattttttttatttccttttttttttcagactttgatagagggagaaaagttatagtttcactgttaaagatgttttacgttttatctttattcttgaaaactggcaaaagaacaacattggatgcaaatgcaaggcaagttgctttatacgattctcagatattcatatataatgcacaaccggaagccttaatcctccctataagaatccaaggcctttgtagcaaaaatacaatctgagccagagcttttaaggatgcaaagtagcaaatgtttgttgatagtttgaataattgagtgcatgtttaattttccgttcaaattattgtcttaccaattttgagacaaatccaacattccaatataaaagaaagaatcatgataagttgacacgttcttcttcactaacatttagtcaaatatgctctaaatcgttcaactcagattgaattctttccctcttagtcaatgaaaacaagttacacattttcaatatctaaggattgtattcataaacttggttagggaagcgagaattgttaacacaagaaattaaggaaaagattatagaaaaaaacataacagcttaaatattaaggttggatttgatttaagatttcacaaattattttcagaaaagtgaatttgggaatgtcacaatctcaagtttacttcattttttttatataaaagaaaaatatatccgcgtatggttgattcttaggaatataaaacattttcatgaaaataaagctcttttctaaaataactccatattcctacttctttcttgagtttcttccacattttttcctctactttttcttcttcaaaattttaattaaatatttttctaaaattattaaatgccaaccaaatcaaacatgtttatgaaaattatatccgtaaacatagtattcttggggataagatttttggaaatgtaatattataccttgggaaaaaaaacctaaattaataaaatgcaaactaatttataatatcggtagagaaatttaaagtataactaatcaaatgataacgtaaaaaaaattacaaaagattgaattggaaaaacaagttactaacggatactaatcaaggatcaggatcttctagagtataccttctcattttagggagagaagtgggtttatctctgtcgtttaattaataaacaatctttactaaatgtatattggctactttttctgttacttatatttatgaattggtcaatccatttcagtgacttatatagtacctcaaaaggaattcatatctaaccatcagccaaatgatatctttagttaaagaacaaaatatgaagaaaaagaagataatcagtacgtactataaggttttcaatgtaacgtccacaaatcaatctaaagaaaatagatgtgagttcgagtaaaagatatttattaaaaatgatcttattcatggtctgtcttatgtaatacgatgtcacagaagctgcaaacaagaaacatccaatgactaagtttatttcactttaaataggtgcataatctttgagagagaatccgaagattagagacctcgctaggatggtaaatgtaatcacaagagcaccattatccaaagaacaaaactaagtaaaacttcaatactaagatatgtcccttcctgcattattaacctgagtttgctgatggagccagatgtactagtacaattgatgcttatagagttgctatgcactcaatttcaatcttggcatccaatggcaatgcggctacttgataagttgaacgagcagggaaaggtgaagggaagtctgaaatcattggaaaagcaggtaaattaaaattatttaagtaactgtaggcattagtgaaaattaaataataccaacccaaagggaaaaccttaatattttcagcatggtactagtggactctctagtatcaatctagtaatcacccttagtatatattaaatatgacaagttgacaacataacctattacctattatgacaagctatcaggtgaatcttcaagactaaaccataaaaaagcatgaaggttttgaatctaaaagctggtcattggtcagccatggtacatgtatgttacctacaggctaacacattctcagcccacaaatgcagcaggatcaatttttacagcacagtacaaattattatcagaagtgaaattcattagtaattagcacagttaagcagtttgtcaatacagaactttcatgatctgcaatatgaaatggattcacacctaaacaagttagtgcaagcttcgccttctacaagaatgtaactgtcaaggaaacattaaaaattaaaatcactaccaaagaactcacatttagcatagatctcattaactttcttgaagtccttcaagtcagccaacctgcaggaaataaaaactcaaaaactagtaatcttgctgaaacgcaataaaccccaaccacaaatgagtgaggaattcatacataattgtcgtcttaacgaccgacgagtaactagcaccaccggctttaagaatttcccccatgtttttaagaagctacaaagggtaattttatcaaatgtcagcaacaaaatcaacaagtgcattgcaacatcaataaaatgttaccatcatacaatacaacaattgacattcaaagaatgtaatatcacaagataaaatgttgtctcattctgtacctgttcagtttggtcttcaacatcatcagatacgaacttcccgctctgcattgaagagcaaaacacacatcaacaatctgaagaaacgaacatcataaattaaaggagtgataacaattaagtgaattaaaaaaacctcgggaacaaggccaagaacaccagacacaaaaagaaggttgttggatttgattgcttgagaatatggtcccagagccgcaggtgccccttcggtttgaacactttccttaatacctacaaacaataagggtcaccattataataaaaaagtaaaagtttaaaaatttgaaggtttcttcataatgggtacttacgagtttcggaagaaatgctcaagcatgtgaatggcaaagagtgcttcggtgacgaagaggagcgccagaaggaggtgccgaccaccgacaaacaccctactccggcggccaatgaagcacggttgcgcagtgcgcttccttccatcgccggaatctggaagctccgagcaccgcagcacgacgccatttctatatctctgactgactctaccttacactctcactctgtcaaagtctttaaccttggactttatttttggggtctttgctgcaatagtcacttctttttaccaaaactacccttatctcaggcactcatttaccattttggtcccttaaaatggatgggctccaagggttcatgggctgggcctatccttcaccctaataacagttttgattgggcccatgttatttacatacatcttttctctaagttcgcacccttttttaggttttcaaaaagtctataggcaattgttaaacatatctcccataaatattagatatacctcttttttttgttattaaattcacttaaatatggatctcttatctctcaatcctttctccttcaagcctttctattttatagtacataattgagaaaggtttaaaaaaaaggaatgagaagtaagggtgaagatatttaataaatttaacaacaaaaaataaaacaatgttgtacataatgttgagtcatgcaataatttatatatatggttttgattaataaaatagttgtgtgaaactgaatcagagcatacaaagaggaggatgagtggcaaaatcattgatttggaccaaaaaggaaggagaaggaaagacatattgaatcagtcaaccatgacatgaaaaataaagaaaaaagacatgaaacctttgatttagctaaattggtcttcatattaaaatttgactctgaatttgatgatgacaaggatgatgagacatattcaccaaatcaagaccagaaagagacccaattacaaaacaattaagaaaatgaaatcatcaacttatgaaacctatccaagttaatggcattagcttcttgagtgttatgtagttgggtttgttcttagtcttggtttgacaacatgactcatcatacttgtcattatcttattcagagtcatattctaattcgaagaccaattcagctaaatcaatggtttcatatctttttcctttgtttttcatgtcatggttggctgattcaatatggctttccttctccttcctttttggtccaaagcaatgattttgccactcatcctcctctttgtatgctcttattcattttcatacacaattattttattaatccaaaccatatatataaactaagacataattaacactatatatggcattatcatacaatgtatatctagcattagttttaaaagacatgcttctttagctttatttacatatgtaatttaaatatcaatatttattattttatcctcataaaaatcttttcactaaatacgctcttagattacacacacagttacactactacatctcccttattatgtcggttatttggggttttctatatcgctagtacgaatcacctaatgtaaaatgttagaatttttcaaattaattatgttagaatggatgtaattttttttacatcatttctaaatagaatcgatgtaatacgtgccaatttccaaaacaaaaatctctcacaccagaaatctaaaccaaaggacaaaacaaacaacaactcttcaaaaaaagtcccaaattgaatcaacagaagaaaaaaaaaacctattgaagccaaaacacaacaaaaatcaatcaatcaatcaaaaataatatattacctaaatgaaaaagacaagacatgaaaaaaagggaaattcatagtacacaattgagtatcaaaatagtgttacctccacagagaattgcacgatgaaattgccaaatctatgtgtgatggaagggaaccctagtgggtgcatggaagatggagtgagggagaggcaagtccagatccactctaccactaaggtatcaaccatcgttcgaaataattgttccatcttgtgttgcaacaatcactcaatcaatagaaaaacaaaaaatgctccaaaaaaaaatactaattgaatcaacacaaaaggatttgttgaagccaaaacataacaaaagtcaaacaattaccgagatgcaatagaattccaaaatgaaaaagacaaggcgtggaactaaaaatggaaattttgtacacaattaagttattgaaatgatgttacctccattgagaattgcatgacaaagttgcaaaatcaagatgtgatggaaggaaaccctagcaagtgtgaagtggaggcatactgagatccacacctccatcaaggcaccaactactgcccataactggtatttcattttatgtcacaacatgcataagatcaatgcaaaaacaaacaatgctccaaaaatcccaatcaaatcaacacaaaaaagtatccgccgaagtcaaaacacccaaaaaatataaataaaacaatcactcaaaagcaatagattacctaaatgaaaaatacaatacatggaataaaagatgagcaatttaaagtatatagttgagttatcaaaataataaatattgatatttaaattatatatgtaaataaagctaaagaagcatgtcttttaaatctaatgctagatatacattgtatgataatgccatatatagtgttaagttatgtcttagtttatatatatggtttggattattaaaataattgtgtatgaaaatggataagagcatacaaagaggaggatgagtggcaaaatcattgctttggaccaaaaaggaaggagaaggaaagacatattgaatcagtcaatcatgacatgaaaaataaagaaaaaagacatgaaatctttgatttagctaaattggtcttcatactaaaattgactctaaatctgatgatgacaaggatgatgagccatattcaccaaatcaagaccagaaagagacccaattacaaaacaattaagaaaatgaaatcatcaacttatgaaacctatccaagttaatggcattagcttcttgagtgttctgtagttgggtttgttcttagccttggtttgacaacatgactcatcatacttgtcattatcttattcagagtcatattctaatccgaagaccaattcagctaaatcaatggtttcatatctttttcctttgttttttatgtcatggttggctgcttcaatatggctttccttctccttcctttttggtccaaagcaatgattttgccactcatcctcctctttgtatgctcttattcattttcatacacaattattttattaatccaaaccatatatataaactaagacataattaacactatatatggcattatcatacaatgtatatctagcattagttttaaaagacatgcttctttagctttatttacatatgtaatttaaatatcaatatttattattttatcctcataaaaatcttttcactaaatacactcttagattacacagacagttacactactacatctcccttattatgttggttatttggggttttctatattgctagtacgaatcagccaatgtaaaatgttagaatttttaaaattaattattttagaatggatgtaattttttttacataatttctaaatataatcgatgtaatacgtgccaatttccaaaacaaaaatctctcacaccagaaatctaaaccaaagcacaaaataaacaacaactcttcaaaaaaagtcccaaattgaatcaacaaaaataaaaaacctattgaagccaaaacacaacaaaaatcaatcaatcagtcaaaaataatatattacctaaatgaagaagacaagacatggaaaaaagggaaatttatagtacacaattgagtatcaaaacagtgttacctccacagagaattgcacaatgaaattgtcaaatctatgtgtgatggaagggaaccctagtgggtgcatggaagatggagtgagggagaggcaagtccagatccactctaccactaaggtatcaaccatcgttcggaataattgttccatcttgtgttgcaacaatcactcaatcattagaaaaacaaacaatgctccaaaaaaatactaattgaattaacataaaaggatttgttgaagccaaaacataacaaaagtcaaacaattaccgagacgcaatagaattccaaaatgaaaaagacaaggcgtggaacaaaaaatggaaattttgtacacaattaagttattgaaacaatgttacctccattgagaattgcatgacaaagttgcaaaatcaagatgtgatggaaggaaaccctagcaagtgtgaaggagaggcatactgagatccacacctccatcgaggcgccaactattgcccataactggcattccattttatgtcacaacattcataagatcaatgcaaaaacaaacaatgctccaaaaatcccaatcaaatcaacacaaaaaagtatccgccgaagtcaaaacacccaaaaaatataaataaaacaatcactcaaaagcaatagattacctaaatgaaaagtacaatacatggaataaaagatgggaaatttaaagcatataattgagttatcaaaatagtgttacctcaatatagaattgctcgatgaagtgttgaaatcaagaagtgagatccagatccagattgtcactgaagcaacaactgtcactcacaatcactgctctatttggtgcagttgccaatgctgttaaaatcacaatccaaattgtaggaacgtgcgattcaacgatttttgaagacatctctgtgttgcatcgtctttaggatcgttggagtgcgagatcagattaaatttgcattctttcatgtgggatatgcaatcctatctaaacaatttaggtgagcaaataaaggtattttgcgagctttgtggggactctttcatgtcgtcgctgttgtgttgttgccaaacaacctctgttcttacggtcgctaacctcctagtactcttctatctacgctctctgtctaccataaggaattaaggttgcacttgttcttggactttcacagcagtggctgatgacacttagcatttataggagaaacatgtaggtcttagggtttcaagggaattgggccaaatttttttctttattttatttttcatatttgatttgttgggccttaattaaagtccaatttagtttatttaaaatgtaaaatattacatataatataataaataaagaagaagaataagaagaaatataatagtattataagtgtaattaacaaaaaataaaacataacaaagaatataataatatgataaactaaaaaacataatatatgatataacaaattaaagaaaaataaaaataaaagttatatattatttataagtattttaggcaaggaaatgtaggatcttatgatgcaaatcacatttccccccactcaatcttaggtaagatcttgatttcaacaaccatggtaacaacagacaccaaatcgaaggataaagtgtaaaagagtttaatcgagtaacactattgacactaaatctaaaataactctccatgtaaaaccaaggttatggtgaagatgcatcaaaatccaactttgctctgcacaagagcaaggttgtaacaaggatgagttgaggtgaggcaaagacgcattagggttaggtgagatccaaccaatggctttgggtaccgtcttcatgtggcagagaaagggttaaggcaagagggagaaatgagtgtcatcctcaaaaaggagatccaatcatctcaaaattgctctatcaattttgaaacctcaaataataaacattattatatagagcaaacaactcttacaatactgtgggtaaagtgggtttagaacgtagtaatcaatgaattattatatagagcgaacaactcctataatattatggtcaaagtgattttagaatgtaaaaatcaatgagtatttatcatatgataagttggacgttggttacaaccatgagtgatagatatgatcaacttatacaataaaatcataagatgaatggtttttattttgggagggttcatataacatactaattgaaaagtcattcaacttaatcttataaattcgtcaaatagatattctctaatattttcaaagaatctgatatattgttcaataaagtatttaatttattgacgttgaacaaataaaaaacaatttaaaaaattgctataaaagcatagaaatataaagtaaataataggaccctagtgataattttggataaaaaaagaaagttgaaattctcatttaaggatattctcttattagagtttttattttcaacaaaaaatatatctttcccattatttcttattctcttttagaaaataaattgctttatttataaataaaaatttaacatctctttccttttcctcttgatgcttcaccaacagatacctcaaatacttgtttttagattgttaacaatattttatttattcacattaactagttaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcatgaaaagataccttaaaatttttgtttttagatttttataatttttttcacatttattagttaaaaaataatttgaatttttttatattgaagcataagaataaaaagtaaataataagatcctaatatgataatttcagataaaaataaaggaaggtaaaattttcatttaaaataaatattctactatttcagttttctagtttttttttataagtttcgtcttattatttattctcatttaaaagtatatattttttaattggaaaagtttaacacctctctcctcttcgtcttactttttttattaatatgtgtgtgtgcgtgtgtgtgtacaataaaaaaattaatatgtacaaactgaatttggttccattcttctcaagtgtagaagtttattctatattaacaactattctgttaattacattagaagagaaacgaattatgttactcattattttgctaaagtgtatgttgttaagatttcatgccagttcatatatatttttattttattttagtgcaacttgtattgagactcttatttagaatcaaatgatataagcttcttccagtaataaaaagataggataaagtctctctctatatgtatattataatttatatattttatatataattataattttaaaaatcttatttttttttataattttaagaaaagtagctatataaataaaataataattttgtataacaataatttattttatttgttatctagtgtgtattaaatattaaataggattagaggtaattgtattattttgttattctatgccatggtcctcatcatcatgcattgccattccgaacttgttcaggtggacggttctggaaattgttcacgttgttgacccttactggaaaaatgggatacaaaagggtattttgaataacaaaataaaaaagaaaaagaagaagagaggtaaatagagtaattggcagaggtaaattttattaatagcctttaccattgggtcgacctctttttttttttttttttcttataaagtttttaggtaagggattggctgacctctataactgtcttttttattatataaattattttaaaaagtttaaaatgataagttgagtaattaattactttataaaaaaaagcaaagttaacacgctctaatttggcaataactttaatagattactatttacaattgaatacatcacagaaattttaattaattttagtaaaaaaaacattccatatctgatttaaagcatagaaaacacactatttatcttttgtcttttcactatacaaactccatatgtactacatggtaggatggtcatcaactccccaattcaataaaatttaaataattttagtataaaaaaactcaaattgatttaaatcattattttggttcaaattgaaaaaaaaaatgatcaatgtaatttaagtctcgaattttgatttaaataactgaacatatctaatctatctgattaaattaaatgatacataatatctttatatatattaatgcagagaaaacactccacatctgaacttgaaagttatctatataaagataaggggcaaaaactctattttagtggatttttttatacatattttatgtttactttgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataagtttgtttaccaaagactattaatgcgatcaagcaaactttttttaactaataaaaaaaattaaaaattaacttaaaatacttgttaaacatattaaagaaaggaactcataaaaaataatgaaaaaattacttatttattgtttgtagttacataaattttatcctttaatctctatacctaaaatccatatcgttttatctttgcacaaatactttcaaatctctcttagtccctgccattatacaaactttattttttagtcattgctatttataacgacaactacaatatgaaaatacttgtataaagactaaaaatataggttttatatatagaaattaaaaggtaaagtttggattgaatgattaattttttcaaaaataaatatataattaatgagtcttgcactgaattaaaatgaatttttatttgataaaaaaacgagcctttctctttttatcaatatttatgtcctattaattaatcacatgttgtatggatttaatcaatcaatcaaatgaggccttcattcaataaagtaacagcaatgaaaacatatgttagcacagagatcttccactatggatggtgaagctatgcgtttattcattttcaagtatcaactgccaaaacagaaagaaggagagggttactgactttaatcttaattagccagtcattgatttggaataggaatattgacaattgttataaattgaaaatgagagtaaggaatagaaagacctaccagttcaatttatcacactattacaggacaagattttcgtatttctggggagttgagaagtggcaagtggcaacttcattcctcacttccacgatattatcagaaattaaatgtgttactactattgcgttttgatcatcaaaattactgtcccaactgaaatttgttatcagtcttttcataccttacataaaatgtgtttaggttgcttaaaggatggttttgggccttttttgggttcacaactgaaattttaagttctattggcccaatcaaaaagttcaatatacctgcctgttaagtagaagaagcatttttgttattggttatgtttcgttgtgtttttcttcttcttttatttctgtaaacctataattcagtctttcaagtattattctctcttctaaatagtccttgaactaatgaaattatataaataatccttagaatattgaattagcataaatttattccatatattaacatgttttactaacgtcctgaaatattttttataattgggatttatttaatacaatttttaatacctgagggattagttatataatttctttactttaggaactatttagcagaaagagaaacaataatactgtaggaataaaattgttgttttattctttttaatttcttcaattaatcttagtatgccgtttaatttatcttctcttgcacacgtagcccgatgatatatatattcgcaccacatcataaatagtacgttaattttattcttattttttatttttttgtatttaatgtaatgaactaatataaataatgttatattataattttgataattttatcttttaaagaaatgatatttaatgagaataagagaaagtatcaacattttgtcaatattagaagagttatcataatataataaagataaaaatgaaaaaaaaaaagttagacctaacttttttttttgtttcaaagaattagatacctatgaacttaaacgttcgtaaaataacatttcaacaaatattacaaactaataaaataaccacttttacaaactcctaacaatttctcaagatcaggtgaattgccacatgttttttgggtaaatgtgttacacgtttgtattaggttattagctattagcactcagctgaaaagatattttaaagtgaaatgaaagattccaaaaatcaaaagtgtgattctcattgttgataacaatattactaatccaaaaatttcttttttcttatataacattacattactccttataatttttacttctctttacttattttttttttatatctttcactagatttttcttttatacatttatctttcactgtatacacccaataaatttattatgataatttttctcatgatttggttaatttatattgttatttttaataaaataattacttctggcattacaaaataatgatagagagaaaaaataattatggattcaaatttctctcaataataaaaattaacaaactaacaattaatatttaatatttgttaaaaaataaacactaaccttcaatcaataatggcaattttcttggaagttatcaaaatagaatagcatgtgaaatgctaaatagtcaacttatggcatgttagttagcaaaaagatttgtatatgacgagggaggaaatagcactgtcccttaattggtatcacttttaacagactcacttcagccacaaatttgctcccattacatagggtagattcatgggccatagctctacaaagacattgcagccttggtcttttgcttgcctttataaacataataattaacataagtatgtttttgttaacattttttttatataattttgtcgatttaaaaaagaatactaagattttgttttttccccttaattaaagaaaccccaaacatgtacataacgacactcaactcactcaagtattcatccaaccaaaactataacacaacaaaataaaatcagcatctccacaaaataaaggttgctttagcaactcaactagccaagcgggctaggaaagttaattgtgacttgaaagctaagttcttttgtagcttcaaaaacttaaacatagctttattattgtcacagaagaattaagaaaagcaaaaccactttgtaaataattaacccaaaaatgaggaggccaggaggggaaagaaagggcatacccttttcctttacccaaaaagatatgtgaaagtaaattcatctttagtatccaaaaaaacgtgctccattttttaaggctttatgtgatcaggtccatggtttgtgtatcatcatctttagcatcagacaattatagttctttgtgtgtatttctcttttacctcaataagtattcatctaacaaataacttaatttacaattatcaatacaaaaattaatcctacaaaaaggagataaaaattaataaagaataacattttgttttacaaaattatcttacattttcataaatttaaaggtgagaatgtttattccaatatttaataagaaattatcagaaaatattcatgaatatcttttattcccaaaaactgtaaaactgggcacaaaataaaataatagtgtttgagattctctattgaattacaagctaaagaataaactacaaagttagcttcttttttttttctcaagaaagttacattcctatgcctacaacttttcttcccattctaatgggatgagaaagttccaaattgacttttatttatcatttattaattaaaagaaatcaatcacactccaataaaaaatctcaatatcatattcgtttataagaaaaacaaaaattaccttaaatattaatagaaatgttaaaagctaaccaaacatattttattatttttatatatgcttaggaataacattcctcgctacaaatttataggaacgtaatttctaaaaatacaagataattccataaaaaataccctaagtatcatttacaaagaaaaacttgaaaactaaatattttcataatgttgtatactgacaaataattcttttttttttctgttaaaataataattacttcaaaattaagaaatgtcaagttaacacggtcaatgtaatagttagatttaaagtcccaataaattgttatttagagctatgacttaattaatttagtgcataaaaattaaaagttaataaaatcatttattaaggatgtctagttcaattaattgagtaagatttatgagttatgataaatcttttaatattaccttctattattgtggataaaaaaaacattttacagttttaaaattataaagtaggatttctatttgaagtgtttcttaaggctttgtttgggagaggaattttggaggggaaggaagggaagggaaaggtttaggtagagagatttccttgtttgggagttttaatttttgaggaaaaggatttgaggatttttaaaactcctctgaaatcctccaaagcttaaaaatggttgtccccctatttgggaggtttttagaaggaaaagtaataaaattactatcctacctcaaccagtgttaataaaattattattctacgccagccagtgttaataaaataccaaaatacaaagcactaaatcacaattcaaggacaaaattataaaagtacgtattttattaactttctatttctctctcttaatatatttttaactttcaaacaaggaggaagaaacttccctcattttcctccctttccttcccctcccttccccttgaatctctctccttcccccctcttctaactcccaaacaaagcctaaaacaacgcatattgtgtatattttccttccatttcttatcattttagcatgaaaatattttttagtgtggcgcacctaccattttttaatttctctccttgttaattaaacttaatcaaataattcaactttttaattttccttctaatttcatctctcttgccagatttttttacctatttcacttctattaaataaaatgagagcatctaaatcttaaattaaaattttagatcacttttttatgaatctcatagtgtcatcaaaatctctatttttttagtggtagatctcattttgagatcttaagaagagaaaaagaaaaaaaaaattattctttttttaataatatgcaaatcttgaaggttattttacaagaaccaatttttcatgttgaaaatttattcacattttttattgaaagatttaataaaaatgagatcttaaatttaaaatatttattcaaaatctaacactactcctcaagtgtttctaataaaaaaaaacgcgagaattattttaattgaaacatagaatctgttgggggtatgagaatttgaccagaaagtgtatgatttgaatgaaataaaaaccgtgaatgagttgcttgctcgtgtacacgttttcttgcttcagagttaactactacgaaaatgataataattatatattgtctcgtgtccacgcttcatgatttacatttcacatgtgtcctatttcatttgatgatcacatttttccaatttccatcatatcaacgtcatcaagcacattatttttctcttttagttacgagtagatttcttttatttgtgattagcatattcggcggagaaaaaatgaataaaaaagaaaagtaaagaaattcattaatattatttgatttaaaaaaacaaatatattttttcttcataaatattataaaaataaaatgcattgcaaggattatttttgaatttttccccctattcttccatcacatttcctcttatgggagggaaaaaattaaagcaagattcacacttttttttttctttgttttcttcttatgtcaaacagaaaaaattacctcttattgatactatatcttagaatataagatacccatcaaaatatttacattagggatttgtttaggtaagcttttctagaagcacttttaaaagaagaaaataagagtaaaaagatgagatgaacttctccataagtaaaaataaacttttcattagttaatttgtagaaactcaccaatgtagcttctctaaaagatgagatgacatctacaaattagctaatggaatacttattttaacttatgaaaaagttcatttcatttttttcttctacttttctcttctagaagtgtgtctagagaagctaacatccaaacaggccctaaatatgctctaattaaaagggggagttgtgtggattttaatatgtttttcaaagaatttaccaatatagttaaaataattttacatcataatttaaattatttaatattattttaaaatataattatatattaaaaattatttatttatcataaatttagttataacatactcaataaattataaatatttgtttattataaattataattatataaaaataaatatttatctaatacaaatttagcttgtataatattccatctaaaatgctagtttttgttttatttttttaaggtaaaatagagactaactctgactagatattgacatttcaattatgttgacaccttaataattagctaactaaaccagtgagccttaaaatgtattaaaagatgacaaaaggtccgtacaaacatgggagacaaacatggaagataaagctatacgcatgaaaactaacaagataaactctatttaaacctaaagttatgacgagtgtttctatcctttatggtttttgttttgttttcttattacttcttctcattttattacttgttaattatgttgttttaattgattgacaatttaaatgaaaataaaagagttaaatataattttggttatccaaaaattcattgaatttggttttagttcttgattttttttttttaaaataggtgaattcagtctctcatcccaactttattaatattttgctggcatgactaataacgatcatatggatatcatatgtttgccatgtgacattaaaaacctttttttttaaaatcaaactaaatctaattttgatcaaatatttaaagatgaaaatcacaattttaaaatgcatttaaggttaattttgactaaaatttcaggaaccaaaaacacattttataacaatgataataatttctcggcacacttgtcatttttttaatattgagaaaatgctctacaaccaaaacaaatttttagtatgtgagaattatttttattggaaaataaaataaaacacttacaaataaatgtaatgtctaaattattagaataatgtctcacactttatcgaaggaagcataattttttcattgaagaccccagtgtggcatgctgatcctgagttcttacgcaggattcaattttaggaattgttgatttctacttaaaggtgtaagttaatttaattttagaagattttcaacttcaaaagaattaagtgtattgcacacatttccttttttggttaaattaaggatcatttaagtcaacctttatatagtagaggcacatgaaaatataatattgtattaaattaataattaatgatttccaataatgtaattgccaaaataaagagatatgaacaatattatttatgattatatatttttatgatctataaggaatctattatgctatttatgaaaattataaaatttgattttgaatccatagaattgtgcacatactaagatacacacatagtacctccatagcgttttttatttattctgacctccacagctatttaatgatttggttaatttacaaatatatttttcaacattcttttattaatggttcttttctcttgacacaatgatcttaagtgcgaagcttatactatctcagataaattttttcattacgcgtattggaaatgcaaaagtctatccaaatacgaacatgagagcagcatcaccttagtccttgaacaacataaaaattacaaaaacaaaaccttagactaaataatttttttttggttactcattaacaaaaattaggtggcaccatgtggtgaacgaatcaggagaaaaatgtggtgttggatacgcaactctgattcggtccttgaatcataataaagaatgaacaaggaagtttttcttctattatatggactccctccaaggctctaaccttgttttggtcgtaaaatagtttcaacccttttttagttaactcgttaaaatccaaatcccacagttgactcggttctatctttatcctttttgttgagactctttctttctactttcctctcctcctttaaaaaaccacatattctgatccattctgcatcaacctttggcttctcctccccccccttttctctctcttcacacttcaatggatattctttcttgaattctcatctgggttcattccctttttcattctttgactgaatcttcacactttcaagtagttggttgtgtggtggtacctgatacaacttaaaaaatctcttcccttttggtgtcagaaccatgggttgttgtctgagtaaaaaagggtcagagccagcagaacacattggttacagacatgttgccggtgctgggggtgctggtgtgtacaacaatcacaagagccatgaaccctttgccacccaaaccaaacccccttctcaccaaccataccaattacatgagaaacatgctcctcctcaggcaccttggaggcctccaccaagcccaaaacatgttcacaagcatgacacaatcactgggaagccatttgaggatgttaagcagcactacacacttgggaaggaattggggagaggccaatttggggtgacttatctctgcactgagaattcaactggcctgcagtatgcctgcaagtccatttcaaggaggaagcttgtgagcagagctgacaaggaggacatgaagagggagattcaaatcatgcagcatttgagtggacagtccaacattgtggagttcaaaggtgcttttgaggataaacaatcagttcatgtggttatggagctgtgtgctggaggtgaactttttgacaggattattgccaagggccactacagtgaaagggctgctgcttccatatgtagacagattgttaaggttgttaacacctgccattttatgggtgtcattcatagggatctcaagccagagaatttcttgctatccagtaaggatgacaagggacatctcaaggccacagattttggcttgtcagtcttcattgaagaaggtatattttgttatccatgcattggtcttttcttatgaatttttaataattgtggggattcctgaaaggtaagtatgtgaactgtagcatagttgtgaataatcttctaaagtttttgaggaaaattttgtataatttccatccaattttttttttttgtgtgtgtgtgtgtggggaattggatgcaaaaggcatgtaagattgaaaatgatttttctattaagttctaatagtgcaatgccaatgcttgacatcaatggcctgattgtcaagacttgcaaagtttgagtagcttttaatttgtttcatgggattttttttctctccctcaagatgtttatttgaataaacttctgccaactaatttttctaaagctttatctccttttccttttttctccatatctatgcgtgcactttatcacatttcagtagatggacatctttgccactcaatttgtgccatgatttatgaattaatttttttgcaagtatggagatggaaattgtaaagtgatggcttgttagaaagggtttatctactgttaatttaaagtaaattaagtttacgaagttgacggttgataaacctcgcttacttattttatacatcatctcacttgtataaaacatactaagttttttctattaaatctttattcttcacaggaaaggtgtatcgagatatagttggcagtgcttactatgttgctccagaagttctacgtcgtagctatgggaaggaagcagatatatggagtgccggagttatattgtatatcttacttagcggcgtaccaccattttgggcaggtaaactctgagtttgatatgttgataataggataatttccttgtattagaggctagcttccccctgttttacagttgactatttttttaataaaatatgtgatgtagagacagaaaagggaatatttgatgccatattgcaaggtcatattgattttgaaagtaatccatggccaagcatatcaaacagtgctaaagaccttgttcgcaaaatgcttataaaggatccaaagaaacgcattactgctgctcaggttctaggtaggtgacttttattgtgttttctcctcattgatagtttgaatttctttcccacttgatccttttacgtgtgtacttgggtgaggttgagaagatagatcactagaggggcttagatgtattccagttctgttagcaacccaacgattgattttatttattgaatgaaaacgaaccgaaacatggattctcctctaaggattccccctttcttacaagcttgttaactctctgaatgaatcctttcacagtttcaccctttcaccatatttatctaattgatcccctccaactaattactctagttcccaactaattttcccttcacttctatctaacacataacaaggctagtggatatagttattactaatagtagtgttgcatataaaaactgaatttagggcttaaaaacttatacgtgccaagttctttccatctgtatagattattctatacccatataggtgtgacaacgacaaccaatgttgcatttgaacatgttagttgctgagactaggaacttttcagagacaatattttcacaaatatactgtttcttctattatctatcctttaaacatgtcagttgtttagttacaggacattctgtatgtgatagaaaatgaaacattattgaacacaagggaagctagtaacagtgtgtgtctttgtcttgatgcagtgactcaaaactgtttcccattaatattactgctgactgatcgcttgattgcaccatccttaagaattttttggttcatgaattatattttctctactaattgattccttgtattgtttaaatatttagagcacccgtggcttaaagaaggtggaaatgcttctgacaagccaatagacagtgcagtgctttccagaatgaagcaattcagagcaatgaataaactaaaaaaactagccctcaaggttagtcaagccacaagctgcatgaagtgaccacaatgctcttttatgcttattgtatttgatggcataattaaacattgagagacataatttttttttccagtgttctcataatgactttaaattgctcgactgtgtgtaactttagggtgtaggggtacatatctctacctattcaaaaataaactgagtggacttaaataatcgttttaggtcattgctgaaaatctttctgaagaagagatccaaggtttaaaggcaatgttcacaaatattgacactgacaatagtggtacaatcacctatgaggaactgagggcaggattgcaaagactaggctcaaagcttactgaagctgaagtgcgacagcttatggatgccgtaagctattgttgaattcacaagatttgccctcctttgctttttctatattctttcaagcttacactcctttgcttaaatttaggctgatgtagatggaaatggcacaattgactacatagaattcatcactgctacaatgcatagacacaggttagaaagagatgagcatctttacaaggccttccaatattttgacaaagacggcagcgggtaagtccatctactgtgaattaacatttcttcctcaatctgtcacattatggaagtaattgttttttcctactatgcattctcaacctcaattttgaagtccatgccttccatattaatcttttgactatcggattatgttttcagtttttttttaataagtatttaacaagatcatataccataaatcctatttcttcctacacccaaaagcacatacattatagaatcattaaataatgaatagctctatttagaatttaaagagtaatgacacatgcaccctggtttttgtttgattacatcacaggtatatcacaagagatgaactggaagcagccatgaaggagtatggtatgggtgacgaggccacaatcagggaaattatatccgaagttgacgcagacaacgtaagcctgtttttctttttgcttactacaattttgtattctagttctatccatagttgacactcaattttgtggtttctcaggatggtagaatcaactatgaagaattttgtacaatgatgaggagtggaacccaacaacaaggcaagctattctgatgtctctagattgagtgtcctgcagccaagatggggtgcttgcttcaggtaaaggcttccaagagttaatattcatcttaggcatgtaaagattgtagtttagatttgttttgagttacatgctccccgtgacttgttgtcaactcttatttctctttttggtttccttttcacttggaagtttattattgagtccacatgtaaagaatttattaggcacactaataataaatggacttgcctagggaaggtggttttccaagttagattctacagtttgttaaattgaaatcctcatccggtatcctttcttaagaattgcactttcactgataaaatatttattgggtgccaaaaggcgaaatatttttgttgctggttatgatttctagcccttcgttttcttcttgaagcgatattggttggcctacggtttgtggttagtgccatgtctgatgacaaccacgtggagtcatgccgggttatgtaagggtgattgcagattagatgaattgaaattagttttgaagagaaaaattctgatctaatcttatcagtagttatttactttaccatttaatgtgttgaatttaagtttaaatctaatctaattttaaagtagtttggattgccaaacccaagttagtaacatggttgtcatccaattcccaccattgcccaatgttttttcatccttgatatggggaatgtagtgaccactattaacagcagttcctttgtgaatagtacaactgacaagttgtatgccaattctaacagaaacagctcagagttcagacaatctatatgtgaatatatcctcctagaagacaccaagaaatacaaaatgcagaaatagaaacaagaaagcagtgctctaataaccctgcatgtgaaaatcagatcaaatgtgccaatgtgagacttaattcctttgaaacttccaaaatacactcaaaacatccaacacaaatttgggtagcttgctgaaaatgtaactatcagtcattaaagtgatagagaagcagaaatttgtaacgttaaatggggtagcacgtgctggtttggatcaccaaaccagtgaggcccactttcaagaaaatgtcggaagtttagtccattagaagtttcaacacaaaaaagccaaggttccttaatccaatgaataattatttttgctaaaccaagtcatcccaaatgagtctagattttatgttgtctttggttgaaagggatgaaaacagagaagatggaaataaaagtagatatttgaattaaagtaaaatgtactaggtatgagattcgcatgtgactcacaatttttctctctctctctattatgcttcccctttcctcaaccaaacaacaaattttggaatgtccaagtacccacatcttagtgtgtgtttagatgagcgttcataaaattaattttgaatgaaattgttttgacaaaatttatttttggttaaaaataattctaaaactatgtgatttatgattgaaagtttttattataaattaggagtaaaaccttatataatatttgttgatcccatgcaaaagatatcagaagttgttttaactcaatcaattttgattttagagtcaattctaaactcttatttaatatgaaaaaaaatgtgaaatttatctaaaattaattttaaactcaaccaattctacagtgtattaaataaaaagaggttaataatagatatcatataccatcatgatcaactagcttatttaaagggattgtttgacaaatataatccttaatctatagcatttagaattgttgattgaatccggttggcaaacaggaacacatatcatgggtttcgatatggagttggtctggtccataactccagtaactgacattgataacatgtggagggtcaaccagtagagctcttaaagcaataactcttcacttggtagagctagaaccactacacaaacatattccaggtaatgactccatatctttaacagcagcccagttacctgttgaagattgaagcagcattgttgcagtcccagtttgtcacaaaagtgaaggctacagactaacccgcacaattgaaaataaagtcctacaaacaataaaaatatttacttatcaactaaatctaatgaatcatatcaataaaaatattttataaagtatattagtaataatatttttttataagaaaaagtctaatcatgtatacaaacaatattataaaaaaatgcataatttaaattataaaagcgaacacataatttagataaataaattatttcttaaacacgttatgccttgaacaatatgtaatttcaaatttgagaaattttttcttaattttaaaattttatttataattatagtgtgattttaattttaaacttttgataaattgtatcaaactgaatatgtctatctttttaaatactctgaatattaatattacagtaatatttatcaatcttaattaaaattgtattcttaaaattaaaattataaatccaataacaacaaaatcttatgattgattaaaattaacgtgttttatttgttttaaataaagttattatttaaaataaaatatctataactttacatcaccaaaaatactattttgaaatttaaattatattttctaaattcaaattacaatcttgtatatatttcaatttcaatgcaattaaaaaaaaattaggtagaagattataaaaaaaagaaagaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttaaacaagttatgccttgaacaatatgtaatttcacattgagaaattttttgttaattttaaatttttatttataatttttatttttaaaattattaattgttattataattatagtgtgattttaattttaaacttttgataaattttatcaaactgaatatgtctatctttttaaatactctgaatattaatattacagtaatatttatcaatcttaattaaaattgtattcttaaaattaaaattataaatccaataacaacaaaatcttatgattgattaaaattaacgtgttttatttgttttaaataaagttattatttaaaataaaatactctataactttacatcaccaaaacatattattttgaaatttaaattatattttctaaattcaaattacaatcttgtatatatttaaatttcaatgcaattaaaaaaaatagatagaagattataaaaaaaagaaagaatataaatataattttacttgacaatattacattagagtaaaatttagttatcttgtcaatatctatatgaacttatctacacaatattatattagatcagattttactatcataattatatattatcttatgatttatctttattaagttttttacacaatctttctgttacaaaacagttatatctacattagagtggcaaacggtgctgattatccagttatatctacattagagtggcaaattatctttttacatccgtgtagtgtatatattagagaggtgaaggaggataataggagatcattagaaaaagaaagaaatcttctaatctgcaaaagtgcaacttaagggaatgggtactgcaggtggaaagaaagaattcggccatggagaagattcatcagcttctattccaatgaagacggtggttcgtgactttcttgcagcaaaagaaaaacacctgcagcatcctgaaatgggtgcgaagatcagtctcgaaagaaaagtcgaaaaagaattagaaaataattataacccatcaaagagagtcaaaagcgaatcccaaggggctagttcttcgcaacatggcaaatcaaagtttgaatatttactagatgcagtggcggccttatttactgaatatgaagaagaacaagattgcctccaagaaagggaagatgctagaaacgaaagaaatgtgggttatgagcaagggccacctgatgaacttgatggattgccaagggaatttcaagaaaagatccaagaattgaatggatgtgaggtgcagtttgtgacgcagaaggaacttttcaaaacagacttgaacccacagcaagctcgcttgtcgatcccaccttcaaagattgccaacacatttctgacaccacctgaggagtcttccttaaacgagcgtcgaggtataaataggaggctttctggcatgccagtgatggtgttggatccgtctttgaaagagtacaacatgtgcttcaagaagtgggaaatggagagaagctacgtctacaacttgaccaagggatggaaccagattgtgtgtaacaacgatcttaaacttggtgatacactgcatctctggtccttcagactctcctctaagctctgttttgcactagttaagaatcaagttatgaatacatccgcgtcaggatcatgatttcaaaatataatcttcaaattagatttagttattttgggagtttatattttgtttaccgtttctgttattcaattttagttattaaactagttttattctaatttttgaaattattcatgttctttatacttattctagtcaataaattattgtaaaggctaaaaatataatgttagaagctgaattcagagttgtaaagtgtgctgcatttagaggtcaagacttattctcaaaatataatttggcttgataatttcgcatcatttactaatcattggtctttaagaagacttattctcaaaatacctatatatactgcggatgatttgatagtattccaattttttcgatttgattttttaaattattatattttgattagttgtaaaatttgttaggtttgtgtatacttatatataggtacagagagagagagtagagaaatgaaacctctaatatgcaacgtagatacataacaatggcaaatgaggaaaagaattcgggaggagctgtaaaaaaagaaggtgattcggttgatatatttttgaggaagggtatccgtgcctggcttacacaggaacaacaaaagaatcctcacttattttcattcctccaggatgacgacactgagattttgaatagcatcctcagaagacaagaccaaagaaagagagaagaagcaagaaagagagaagaagaaggcacgtccaccaaaggtgcttgcaatagcagtgctaataataatgttggagattccaagaattacaaggccatgtgaacaaattaaagattcaagaaatgaagggatgtgaggtgaagtttaaatttgttggaactagctctccctagatctctgaatatctacaagcacttcttcagtttatctttaattcaaaaaataaactctttgcatttgtcttcaagttcaaacaataactctgttgcataacaatgttatatatcctttagttgtttatgtaacaattaccccgtgccctgtgctgcatgccagattagtgaaggcatcaaaggtccttgcatacgtttatcaatccatcacgatgataatgaatcatatttatctcaaatacttgttagatttcgttgcaatcaactaatcatgatgataattaattataagttttattaatgattaataataaaggttttaaattgcaattacaatcaattcattaggttagaaactaatcttattcgtacgtgatgactactaattcaaattttttttttttgcatcaaatacaattttttcactaaatacatcatttttccatatatgaatgcaatggagcattacacctttatatcaaccttatgaattaaaaacaaaatatttcttttacatcatgcaagtacatataattcgtagggaaaataggaaaaaaaagaaagaataaaatgtttttgtgtaatagaaacattaaacttggaactcaaacgttcacaaatacaattttttagaccaagtaggaattaaaaatgagctaggaagatctaatgttgaaggagagacgaacctgtgagaaaggaggacttgtaaacaaagcaagagcgaattgagaagaataggtagtggtggggtatatatagtagcggggtgtgcaaaacagaataagcaatttatagcagtgaaattttttaggacaaattatttacaccatgcaattaaacatttgatagtataaagtaattttataaatgtacgtatatattatatatcgatataagtttacagatgttaaatattgatttacatgttaatataacatctgaaaattggaaaataaatataagtaaattaaatttcataaaaatattagtatagtatttattgttgttaaagtaattttagataattatttagataaatagacttttcttttatagcgtgaagaatttttgttaattacttaaaaaatttaaaacattaatttagaaaatatatttaaacgttttaattaattactttgatgtcacagccattttcaaaacctcaattgctttaggagtctttttttttctttctgtgtttgttggaaaacatagaataatgctgaaaagagttcagtgattcggagtacttattcttgaataatatcgttgattatttgttgctattttataccttaaacacaatcgcaatgttaagcataagcattcaagaacatgtcttctttacccaaaaataacaagtattcatgtgtgtaactctttaaataatcaaaatacgaatataaaatgctcatagatttcaattttgaaatatttattcaaaatgctcacatatgctctagctttgccaagatatttaaatactaaatttgtaaaatataaatataaattaaattatataactaaataaaatagacttactcaatgatttcttttgatttagagaaactattcataaacttcaattggattttttttagaaattattcaaattcttttaaaatggagacaaatataacattttgaattagttaaaattttaaaaaaaataaaatacgaagcgtgacttttatgttttaataatcataaaaaattgtttacccaaacacccatcccaaaatatgtaccaaaatactctttcttattattattcagagtagctaggtaattggctattttttccgttcccaaattgacttttgattcaccgaaatctcaacattctaaattgggttaaataagattttgtcattatagaatttcaaatttcgagttttaattcctataatttttccttatttttagttacttgtttatcatgattagtctttatatgccgttttgatgtctatttttagttcctctgagcaactaattattgtatttttagaagcacttagcaactaattatgatgaattattttcaaattatttatgcatttaatatgtccttatgttttaattttttctataaaacatattttagtgtaccaacattgaaattcatattaacataatcataaagttatttcaaattttacttgttaacaattaattttatcaaattaattttacatactgtattttttatgtatataacatattacgttgaagtttatttattacaaatacttaaattaacaattaatagcaaagatattataaattttatataatattttgtttatatgctacactatatgaaataacaaagagatatatttggataaaaaaattaattcacttgaatggaacattaaaaaatataataagtacaaaattaaaatataatgtgattcaaaaattatttttccattcgagatgaaagtaaaataaaataatgaagtaattatttgacacgaatttgttatttggtttatattttacaaaaacattagaagtatttgattacttagcttctatatatgtgtgttacatattacttgtttcctttaattttcatgtgatatagactaagtgtcttgattcatggtcctttctcttttgttaaaaactttccttttgcattgcaatattgaaaaagtagccgttaataactctactactatacaaatactcttggcaactaaaacatcaaatcttatgtaagatatcctccctctcacacgagcaaaatatagaagagaagaaatctttcttggatgccaaatattttcctttgatttcatttctttttgtttatagatttgatatcacgatgtctggtaggtgtgcagcttgcaagaatcaaagaagaaaatgcccttcagattgcattttctttccatattttcctgccaatgatcctgaaagatttgcgtgtgttcacagaatctatggtggcagcaatgttggaaaaatgcttcaggtgttttaaatatagataataatatttgatatcaatgtgtttatgttagtctataatatggaaaaatttatcaatatatcaaagttagaatatgtcatccaaagtcaataagattatgttactaaataacctttgtatattttgatgttgcagcatattccatcatacttacgtgaacaagctgcaagttctttgtattttgaagcacaatgtaggattcaagaccctgtttatggatgtgctgggattatctctaaattatatgaacaaatcaacagtacagaaattgcacttgcccatgtccaaactcaaattacttgtcaaaagcttcaagtcccacgggcaaaagctgaatcaaacttcaatgtcttgtcaataattgaagctgaaccaaactttgatgtcttgccagcacaaagcagcagcacagcagaatttcaatgggaaagtcaagttccttggtttagttaaaactaccatttccaattgatacaaagcatttgatttatatttactatgatgtcacaaccattttcaaaacctcaattgctttaggagtcttttttttctctctgtttttgttggaaaacatagaataatgctgaaaagagttcagtgattcgtagtacttattattgaataatatcgttgtttatttgttgctattttataccttatacacaatcgcaatgttaagcataagcagtcaagaacatgtcttctttacccaaaaataacaagtattcatgtgtgtaactctttaaataatcaaaatactaatataaaatgctcatagatttcaattttgaaatatttattcaaaatgctcacatatgctctagctttgccaagatatttaaatactaaatttgtaaaacataaatataaattaaattatataactaaataaaatagacttactcaatgatttcttttgatttagaggaactattcataaacttcaattgaaaatatttttagaaattattcaaattctttaaaatggagaaaagatataacatcttgaagtagttaaaaaaaaaatttaaaaaatacgaagcgtgacttttatgttttaataatcataaaaaattatttacctaaacaaccatccaaaatatgtaccaaaatactattattcagagtaggtaattggctattttttcgtacccaaattgacttttgattcaccgaaatctcaacattctaaatcgggttaaataagattttggtgttatagtatttcaaatttcaagttttaattcctataattttttcttatttttagttatttgtttatcatgattagtgtttagggagttaatttttagtcattttgatgtctatttttagttcctctgagcaactaattattgtatttttagaatcacttagcaactaattattgtatttttagatcacttagcaacttatttaattcttcttaattttatatgttttattaatagagttcggcttttcaaatgaacatgcttttattttatttcattttaaatattaatttaatttagttgtattaaaataatttgtttaaataattaaatatattataattaatttttttatttcaattattttaggggttaaaaatgtgttagaattaagatttaagattttgtattaaaagcatgcattttaattataaaaaatgatcaaattgtatttcagaaagccttaaaaactaatatcttgattaaaattatatatttataaataatataaaaattaatattgattggtcccacaacagaattaaaaataaatactatatcaaaatcaatatcctaaatggtgacaggtctcaccagtaaacatgcgtaaccttatactaaaaatactagattctccaacaatttaaagatcttgacgtggacttgtaggaaaatgtggattttaaaagcagatccaaacacactattggattttttttttctatcgctattgcacacacaaaaaatgcataaaaagttcattagatccttgcttggccagaaaactaacacaataacacatttgtttttcttttttcttttttttttatcagtagaataacacataggttacccgcacaatgaacgtgctgaataataatctcccaatcccttttaactagtgcctgaatattattgattctgcccaacatgaaattttaatagaatttttcatttgaattaagttccaacctaatctagacctaacaatatatagaataagattgaaattgtctgatttgttaacatgacaatgacatcaatttttatattattatataattaaatcacaaacttgataaaaatatataattacaattaaaatatattttaaaaataaataagtaaaaaaatataatttaggtaaaacattgtgtattaaattatgtctgtattaaattatgtcagaaagttcaatcattaataactacgggtaaagttagtgagataagtcatgaacattactaattatagttggcttatttttaatttggtgtactatttgattagttgatgtcacataaaatattttaaaatgtaatatcaaatattgcattttgatacttaaaaataatcatcttaaattttgtgtgtatatttgtcataatcacatcacatataaaaaagagttaaattgataaaatttaccactcgctttaaagttatgtacttatgtgggtgcgttgatcctccaaaataaatatcctaatagtcaactatgaaactttaggtacttttaaattgaaaaacttgcaagttttgaattcataacttgatctctcggagggttatgcacctgtagctggcttctttccatcaatgaacaagcccatggttttgaaccaccgcatcagatttcgatgttccttcacatatagccacgcttgaagaaatttaaagaggctctcgttcactcctcgctcctcaatgtaactgtgaaacgcatctctcatcttttcatctagttctctgtcatttacagaaaagtcagtcaaaactaaaaaaaatgcctgcggcacaaaacataagaatttccaagcgaagtttaacaggtatatgataaaacacaaaacgggcattctaggacaacacgcgtattcgtatcttccaaaagtaagaaattttttcttctcccaaaatgcaaaacacaattccgcagtttcttctctaagtccagcctatcttttctcagggaaagagcatcaaaatgaatcaatcacatcacattgacattgaccttaattaaacactcacaattgagttccaaaatgaaatgaagtaactcgcacggtagagatgttttcaacaatagttattgctataataataaataaataaataagagccaatacaccactactccttacagcaattgaagagttctgagtggagggcattctacttcatctccattcttttaatcctaaattcctaatatctacaaaaaacttaaatgcttcttcccaaaatctacattttatacctaaatatagaactcggttttctaagaatttgggttttgaacttaattcaatctcaaaatctaacttagagggagaagtgattccccacctatatatactattttggtcatatcaatagttatcgtgaaatctccaagagacatgcttaccccggaaattacacacaacttatagcttgcaagattgaatatttgtaggtgatccaataacaacacctgataacgagtagtctaatgaatccaacaacaaccactaggattccaatgccatattagaacttcaaactctaactcatgcggtaagtgttgttccccacttaaatcatatcaccagtaaacgtggaatctccgtccatgtttgatatatctttttccaccttatactttcatatactctagagattgcaatgacattaatttaagaatttaacggtgatgcacggacagtatatagttttgtaaaaatcaacaaacctactatccgtgatttgtgattggatgattttacactatgagtgcatactttttttcttcttcgtaatttaattaccaatctccagacctacgctacagaagcataaaccctaaacaaagaaaaattgagagcaaagagcacagaactgacgcgaaaacagggcctgtgtattgggaggggatgaggaggtagccggagtcctggaccttgggcctcatggaaacagagtgaatccccagagcatcctcgtacaaaccgcagaggaaaatcaaggattcgttctgctgaggtttggagacgtcgacgtggatgaagagctggtcgatggcggaatcctcgtcttcgggggtcaacaaccgcatgacatagatgctcacttcttcgtcgccgtagctgcgcttcagaaccggaccgtgcgagtccagagctcccttcacgatcgtgaacggcgacggaggactcactttctgctaggcacgtgccactctcacgtgagttagtcaatgtctaaacctaaagtaaaaccctagcacataacagagtgagagagagcttacagggggcatgttcattttggcgacttcttgatagtgatcctttagagagcggaggagcattgagttcaccgcggaggagatgccgtcacctcccgacgaatatggccgccggagagcacccacggcgccgaccaaggttctcttccacatttctctatcttttccttctattcctgcgctgtatgagattgtgttgtggcagcagctcaacccaactcagactactcaactctaacatttcaacaaaattatattaagagtttaatttattaatcaatcacaaataattttaattacaatttttagtatttattataaaagctaattatctaactatgcatatataatttattttcaaagaacaaaagccatttttttccaacaaattattatgattgtgaaaataataaaattgacaattttattataaattaaagtttgataatattattagtatttactattagaagttatttaattttattttctcattttttctatatagttaatttttaatataaataattttatattttttaggcataaacatttttttagtcgttttttcattagtaactcaacttttcaaaaaattaagtttaatacctccttgttcatcaattaatggtttcataattttttccaatttttaaccatcaatcaaaatttattattatcaattttataaaaagtgatttataacaattttaaattatcaaaatatttgactcgtagtataatttggtgacactttttttgtatattttgacaattttaaacaagaaaaataaaaatatgaatgtgaacttgtgacgatttttaaaatatttttatgattttaaactgtcacaatttttttttaaagaaatcaaactaaaaaaatatatttttgatggttaaaaatggttacaaattataatatcattaacgcaaaaaataaaaaggactaaaaacaacttttcaaaaaaatttacatgttcttttgcaccacaaaagtgttcaaacacaagctaaaatcaattatacaaaatcaagtttattgaaaatgaatttaagaagctccaattcacacacatagtatatgtttgatttgtaattgaaattgttgtaacacacattttaatgcaaatccaacagatgaaaacaaaataaatgcaaaagcaagaatcctgatgcgttggcaaaatgacttttgcctctaatgtaattttaaaacggagaaccaaacatgcacaataattgtagcttaaagcctgttgtcatctgactcaaatcaaaattatagttgcagctaaaatttttgctttagaaaatttgtttctccgtttgagatatttcaaaacagggtataaattgccagacactgtcctttttctcatcaaccattctcataatagtcgattttaaacagttttgacagaattgccatgcatcacaccattccgcaaaacaatgccactctcagcagaagcaccgttaggtagcagtaccacatcaataactttcggccaaatatcatgcagaaagaatcctttatccttttgaatcaagagcttcttccaaagcaatgatgttggaaaattaattttacatttccacaataaatggaacaaagcaacaggcaatcatatttcttccataacatgggcaactgaacaatttttcattttgtgagaaacctcaaacaaggcacaaattgaaagccctgatctttctgacttgtcaaaggagatatcttaagattcaaaatctgtatgaccaacaacttcttactatatacagaagaagttaatactactagtacattttggggcaactgaaaaatgcatgtgatgtgagaattctatgagcttcggccatgaagggacttgcttgcttgtgaggctaagaccattgccttggctcttgtgctcatcagcatcaattccctcactgcacgacgctgatgttgccgggcatttttagctcgcttcggagctaatcggttgtccctttccacaaatgcaagtctgaatttttcagctactgataattcagtggaacttgaagatggagagatgggcttcaatgcaaacccatgcattgtccatgttctgggatcaatatccttgacaacttcatcatccaatatgatattttgtaatgcttcccgaggaacctcagttcccttaaacccaaagggtgatgacttaggatttactacaacacgtgggcactcagtggaaaagtcctctaaagaatttttatcaatgtttggctgcaaataaaataaaataatcacttctggaaaaaatgtcggccatgaaaaagtattaaactattagcaacttctattttctatatgcaatgagaatcaaagaaaaatccttatccatgatgcctattttttcctaattctcactccatcccccaatggctggaggaagtgcagcgtatatgtccctacaccaaccaatgctatcataaaaacaaagacatgaatttttgcatttcagtaaggacaaaaattggcattcaattacaaattagacaggagttttcaagttcatacccatactagccacctgagtgattgtgccccactagcaatttcttttgtatcaagctcctcccaagaatcctcctccacataatcatcaaaccttggtttaaatatacccaagcatcttcgtgcagtgttgtcactccttggacatcctctgcaatattaattatggttcattgcctgttatgagttttgtaatgatgtaatcctagtcaaaacacagtcttgtatccaatgtgatttattagacaaaaatcagtgtgtaataaagtaggaaattactaccatgaaaacaacaaaaaagaaaagaaaagaaaaagcaccctaaacgattttaaaattacataattttccacctttttaatttaatttgatttttaaaacaaagagagaataaatatagaataaatttcccaatacctacaacttcccaagtttcggataacatttgtttcgtgagaatagacatcaattttttatatcaaagccaatttttggcattataaataaatgagtaagtaaatatgttttgatcatctttacaagagaactcaatttacagatcctatcgacaaaagtatgacagatacaatagtaacaagaacatggtactaaagggcccattgaagtaaaattacaagttttcagattatgtcttaaatgatcgacaaaatacagtctaaaacaacacaatgaacaaattgcattaacaaagaaataaaacttaaagtggataacacaggatatgtacccgcatctcaatgtctccaataagtggcagtgcttcacaagctcggatataccattagcagtaattttggtgcaccggctgcaaatagtctcaatatatcaagtgattctgaaagagagagaagtataatataaaaaaacacactacaaaactacaaaaatgattgttagcatcacatcaatcctacaatatgctaacctcaaggcaagttgttgacggaccaaaaactaggtgaagaaaattaataataaccacatccagtagaagtaaaaccatgaaatacaattaaaattacaatggaagaggaagatctaagcataaaactcaatctgcattcatcactcacttctaataaactcatgatatagttcagacagcaaaatattttctcaaaatgtgcctaccagctggtccattgaatgggacatatgacatgctcttgtagcatcaagtaagcttcagagttaagactacaagctagagcatattgcatgaaatgtcttctgaaatttgaatatacatgaaaagactaaatattatgaaaattcttgttttttcagattatttattctcatttctcagacatcaaagatcgattgcattacaattaaagcatagtagttgtttcatttttttaataaaaaaagttatagttctataccttatatctagagctttaatgaatctacatacttcagctgcttttatcaagccaaaatcagagacatctgagccagagacatcaaggatttcccaggaagtatcagctaatgcgatcaggatatcatcattcagcaattttcttcttctagcaatagctgccactgctatctgtcattaagcataactaacttttttatttgtattgtatgtatgtataaagtacatgatgcaggatgaaggattctttttgttcttttttgggggaagacacattataatcagagatttttaacaagggataaacaaagaagtgtttaggacagtgagcggaacacaagtttcaaacacttaagaatattaaccgggtgcctcaacaaaggatatttctctagcaaagaaagcgggaaatcctggagaaatctttgtttcccacacatttacattgagaacaccataaatttagaatttcacttgttgacaagtatgagcattaggataaatgacttattaaaggatttgaagaatcagaatcattctctagcaacctacctttatatcagctggcaagttgatagcaatttcactcaaatctgcaacaatatcctccaaatgtcttccaagaactccaatgcaaagactgactaaactcggtggctttgtcttcttaggcagtaatcctgcacaaaaatttctcaaataatttgttaatgcctattatgtggcacatgcttatgaaaaaataattggtgcatcgtgccaccaaggtttaaaccctaagatctcatttaaactaccaaaacctctcacaactaacacccacctagtgtctccttcaaagagaacaaattttagtcattctattcaggggcaaaactcaaactgagcttccattgtcagcataatctagtcatacaaacacagagtctaagggcaaaaccaaattaaacaatgagcacttgccacaaaaccaggcaatatgatcaaaactgaaaccaatcgcagtaaaaggcccaaatgagggttgaagtgttttttgtttgttttttaagttttctacttaaaattatcacagaaacaaagaaccactgcattttagagttagtattgttttgtcaacggtctttcaatttcaattgatccccaaaacagagcaagtgcaattgatcatgggtcaatgaaaggtgaaagctttaccaaaaaccaaacataaacataacaccccatctctaaaatacaaaagcagattgaaagagagaaaagggggtttaaaaaataccgggaaattgagggtgggtgattgaaatggaagacttggatttgacgttggatggtggattcaaatcgaggttttgcaaagaggtcgctaatgccttggcacctttacctttatccatccaaaatcaaaatgaaaaacgatgtaacagaacgtgcccttacacaatacctcaattctgaggaaccaaatttgacggtgttatcaacttattctaatctctctctcttcttgtgttatgaaataaacgaagccgactatacttgcgacctcctttggaaaaattaattattttctgtattaattttaatatattgttgcctaacgattttgttaaaaaataagttactacggtatacagtacatttctatttttatataataaaaaattataacaaactaatacttttcaatatataaatatgttatattaaaatttataataagtaaatatttttaaatatataatttatgtttaaatttataataaaaaattaaattataatataaagttatttttttaactattcttatgtttttttagaaaaaaaaaaactgttaaaatagaatttaaagataaggattacaaaaatggtatattgaaatagactagcagttaaaatgattaagtatatatatatatatatatatataattatataaagattttaaaaagggtgatttgaaattattaaatataaatattttgattcattgcaaaatagtgtgtaaatgtattagtattttttatatataaattataggtatttgtcaactcattattggagacaacttatttaaacagagtatttggaataatatgaaatagggtgttcatgacctaactctagcctcggccctggggtagggccagcagggccttcgcccagggcccaaaaatttttggaccggtagtttaagtaaaattttttattaaaaaaataaaataaaaataaaacctatggggttcattttgtgtgttagggcccattttgtgtgttagaggctcattttttctatctcttaattttaatattatttgtatttcaaaaaatttgtgtattagaggcccattttttccatctcttggttttaatattatttgtatttcaaaaaatttatgtatcaggggcccatttttttcatctgttagttttaatattatttatatttcaaaaaatttgtatgttagggatccattttttgtgtgttagagactcatttttttatccctagttttaatattatttgtatttcaaaaaatttatgtattaagtgcctattttttccatctcttagttttaatattatttatatttcaaaaaatttgtgtgtaagggtctgttttttccatcccttagttttaatattatttatatttaaaaaaaaatgtgtggtaaggattcattttttccactttaccccggaccaaagaattttctggatcagccctacctaactcatcttactaacttaatctgttcttaaaggattttttaacgagttcaagttaaagaaattagatatttgtttcaaggatggatttagagttatattttaggtcatttcaacctactccaatgtcatttttttaaagtataatatttaaaaaataattatatattgataatacaacttgacaaataaaaaatattttgtttgatagaatattatatttatattatttattttaaaataatattataaaatatattttaattataattatatacttctttaattctacaaaataattatacgtaacgttaatagtattaatatatcatgtaaacaagataagtttatccaagtctattccatatatatatttgtctagttttaattgaattgggttagaaatttagaactcacaaaagttgtttatatttatatttaaaaaatttatatttttaataatttttttttcaaacacttataactcttatgtctaatttgttatcgtctcaatatgtattaataaatttaattgattattgctcttaaaagaaagtctcattgtttgttatgaacaaaatcatacagtagtattagtgatgatatatagacatatagtacagattaaactcataaagtattaaatatttcaaaagtaggtttggtttgttacaatcggcaaaaccaaacatacatttgtcgtaactcgtaattaaattagttaggcttttgtcaactgggcaactgtccagtgtccagcctacttaggtgtaaaaaagcgtcattttttagagtttattttttatgtagtgttagtataaaatatttctattattaattaataccctaattagtattctttttctattatacataaatataaatatttgttggatatttttaaaaatgtacattactaattctttgagtattttgatgtttctaatcatttattcattttttattaatcccttatttatgttaatatatgtatgctaattcatataaatgatattaaaaatttaaaaagggtacaaaattatggttgatatgtttttaattttttttacaacgatatgttttctaaaagttaataagattatcatataataatacatataatcgacattgtaaataaatgataatattacaagtaaagaaatctgatattggaataattctgtatattcctcatagtcataaaatgtacagtgtctttgcttatatacacaaaaagagaatcattctagaagctactttgttgtaactaactttcctatacaacctcacgtataaaaggaataaaagctacaaagcactacaccactacaaagcactacaccactactgttataacagaaagtaaaatacaattacaaaaatgtcctatgcttaatactccccctcaaggtgggaagtaaatatttgaaagataatataatttttttagatcatccgtgaagagattagttacttttttatgtaacacttaaaatattatcattttaagtaaaaagattatgcttttcatatgaattcccattccagttagtaaaaatgaaactatccgttttaaaaagaatcaggttcattctgattcgaacgtaatataaacatatttatgtacttttgtttaacaatataaaactgtgaaataattcctttattttcttataaaagatagcagtgaagacgacattacttcaattcacagtaaacaaaaaattttgggcccaaggagcattcatagaaaaaattacatttactttactttaagataacaagtgagagtttgaatttatgacttgaaagataaactcagtttcatttcattggacttgcttgagttttgttttttcttccaataattcatgacacagtataaaaacttttatgattaagtaatttaaagtttaatttctgttgccatgattttatccttttaagaaaagttaaattttaatataagaaaaataaatttatagattacacttcaaactcgcgaaacacgttgaaaatacaataattatttgtgtctaataatacttaaaggggactttttagtctttaggtaacactttaacgtttgataattggtaagcattgactagggacaaaactcacataactactccatttgatataggtgtggtgtgctatactttaagtaacgtagtgagctaatcccacttgcgtgggtgagttaaataaaaatgcgggtaaaatctatttttggttcttgtatttttatttaaaattagttttaggttctgtattaattttcaaattgattattttgatcttcaaaatttaaaaaatatgtaaatttagctccttaacagcattaacattgttaaaggaaaaggactaactctgcatatttttcaaattttgaaaaccaaaaatggttgatttgaagttacaaagattaaatcctattttgatccgtttaaaataaaaatattaaataaaagaaattttgaatattttaaaaaaatttaaatgttacaacttatttattcattttaattttaaaataaatagcctatgtactaatagtataaaaagatattaactaattttacaataatttttttaatattcatacgtagtatagtttcttaattattaatagtataatttttttacaagtaataaatttatagtttcaaattcttaattttaattgtttaatagaataagaattactgtatatctggaaattttttacttaatttctattcatatatatggtcaactataattttaagctgaagatctaatcttgggaatagatcttaaacagaagatttgaacttgggatagatcttaaggatatagaacgagtatttggtctgctcaaatctcaatttgtaattatatatggttcatcgcatacttggaacatggatataatgaaaaatataattttggcatgtattatattacataacattattgtcgaagacgaacgagatatatttagtgacaatattgatgttgattattatcacataaataatgacatttcaaatgttaaagtatcttctaggtacttccatgattttactaaatacttgcaaataagacgctttatgtgtacaaaaagaattgatcaacaaataagcatacttgtagagcatatttgagaatgttacagtcacaacaataatgaattttttttttgacattaatatgttgtatttttttattatcaaatttatgtattttttatttatttaacatttagtcataaataaaaagtaaatttatgcttattttcctatttcttaatatttataaaaaaaaattcttacatgttttattaattaaatttaattacttaattaattatatttaatttaataaatatttatataaaatatttaaaaatgagatccatataagacctattaaaaaatatctaagatgagatctacaactaaaagaaaaaataaaaaaaaaaatcttaaaattttttaattttatgtgacacattaaaatccatcaaaaaaatatataagatttcaatttgattttataagtaattatatctaactttttcttcctttataaaaaaaaaatataactttttagttttttctccactaaactaattgatgaacttaaacctgctttaaccaacataaagttatcagctagctgaatttcaaaaaaaaaataaaaaataaaaaatagcagcctagttttccctatctatttaagcctagttcttgtgcccattaatgcagtcaggtccacctctcacattaacatatcaagcaactagcttctcaaattgcattcctattacataacataacaccctccatccttggacttaattcacactcccaacgcttcctctttctcccataaataccttcattcatttcaacaccaccaccgacaccacttcctcacttttgttactttcctagtttttctctcaatatggttatggttggagcccttctcctcaacgccaacttcaagattcatttctcacgcatatcaagccaagcccctgtccccttacccgtcaagcccgcaccgctcagaatgcccactccccactacccccactgggcctccttgcaggccgacattgaagcccacctcaaacaaaccattcccgtcaaagaacccctcgaggtcttcgagcccatgttccacctcgccttcgccgccccccggaccaccgtcccggctctatgcctcgccgcctgcgagcttgtcggcggtcaccgccaacaagccatggccgcggcatcggccttgttactcaacctcgccaatgcacacgcccatgaacaccttcctctaaccgacaggcctgggtccaggcccatgtacggccccaacataaaactcctcaccggggacgggatggttccgttcgggtttgagttgctggcgaggcccgacgggccagcacgtgcgagcccggagcgagtcctgcgtgtgatagttgagatatcacgtgcggtggggttggtggggttgcaagaggcgcagtacgtgaaaaaaacgttgtggaagggtgaatcggacggtggtgaggaggtgcaacacgtggaaagcatgcaacgcgttgtattggagaaaagggacggtgggttgcatgcatgtggggctgcgtgtggtgccatgttgggaggtgggagtgaggaccaaattgaaaggttgagaaaatttggattccatgtggggatgatgaggggaatgctagaaatggggttcaaggaaaaacatgtggaagaggagagagagcttgcactcaaggaattgcaatttttcatggacagagatgttcatgttcttcatcttatttctagttttctttattaatttctagccagttttaaggaatctatctggaatctcaagtgggttattatccatttacatatgtacggaacaatggaacatgatcaactgtgcagttcataaagaataattgcacgatcatgcgtttcaaatctgatggtatgtatagcagaagtttttaaattatattttactttataattttactatatggagactccaatcttcatatagtatgatggaggtagatctaatgtttttttttggttgtgtgaggagagaaataaagtagaaacaaagtattgttaggttgtttggttttaaaaaaatatatgagaattaattgagtgaaaataaaatgataaagttataaaatgttaagattacatattatttatttgtgataagatagcaattagtaatttagtcctcattatttattattagattgattatatgtaatcaatattgatcatatttgttcattataaataaatggttagtgttgtcgtccttaacacataaagtaaaatattgttatatgatataaaaatttagattattcttcacaaagaatagtgaaaatcatgctccatcgatgatttagtgtcaagtccccggtggaccttttgctcgttgcccatcttccagtgaccatttctcctttcctaatgacttttctgagcgactattcttgccattgtcccgaaccaaacagttttagttactttttgtttttttccctcttttctcaatcgcaacccctttgttgcttgaatagtatcatgactattgtgagcactggcagagctacattagaattggggggggggggggggggggggnnnnnnnnnnnnnnnnnnnnnnnnnnnnnnnnnnnnnnnnnnnnnnnnnnnnnnnnnnncactctaattttatgtatttgaacctccttaccagtttacatgtgaaagtaagtaaatgcacactcttattttaataaaatgcaaatatttatcttaaaattttatattttgtacctcttatcttcgtgtttaaatctaattattctatatgataataatagttatcaatttttatttttttaaataaattgatcccactgacccagagtcctagatccgcccactgattgtgagcactattacattgccactatgttgcctttttgtcgatgtgcctagatgatcgaaagtgtctcactctagcaaacccaacatcgcaaatctcattgtcgtatgtcaccaccctccgatgcgagacactcacgcgcctgcaccgaatcaacatgtgatgttgttttttgaataacccatcctccgatgacctccccatcgtgcttcttcttttctggaaaaacctatttttgcttcatttggctcgatttgcatttgtttggttgctttggctattgtatctaccatcctagctagtagttggccaaatagccatgtgacacattttccagcgtgacctacgttcagtgaccatgccatcattctcatcttcttccgacaaccctatttcgttgctgtttgactctgttttgtcgttgtttggttgacccacaatccagcgatcgcatcatcgcactttgtctctttccagcgacctagtcaaagaccaccatgccatccacgtgcatagccaactcaaaataccacaacatgcgccccacatagggtcttggtgcgtgatgatcatgcacacgacacataacacatctccaacaagcatcacagtggtcttcgtcgtcattgcgagcctttgttggctgccatcgaatcatgtttatccgatacaagcacactacttgaattacctttagtttttatcgaattgaccacatttataacaagctcgagcttaagggagagttttaagattacatatcattctgttatttgtgattagataataattagtgatttagtctttattagtcattattagatttatcctatataatcaatactgatcatatttatttattataaataaaggtttaatgtaatcatccttaacacaacattacagtaatattgtcatatgaaaaatattgatatatccttattaatatatgtttttttttatcaaatgaatcagtttgatgataaaaaagacaaaaaagaaaaacacaaacataaatgtacacacctcatccttaccaaggacaaaaatttcaaaggaggaacgcaccttctcccaattaattaaattaaatcttgctcacaaatcaattccataaaaccacctaaaaaaactccattgttgctcgttgtccctatcttgtcgctgacaaccacaacttcaaaggatggtttgattgtgtgggggagaggttactatttaagggaaaaaaattaaaaaatagtgcgtctgacatttattttttattttaattcaaatattttttttccgtttctctttcattcttttctcttctatacaaacaaacctaccccaagggatacaagtacacaaggcaaaataatcctagaaatattttctctacaaagaaaaagctagacagggctctaactatagtgacaactacgttaggtgtgagttctgatcacttttccttagtgattgattttattccaaaaatgagaagtgataaaaaaaagtacaatttaaatatatagtctcagttaatataccaaaatttagatttagttattcaaaataacttttgttggatttgatttttatatattttttaaatggtcgctaacattatttagtgattgcaggacatgtatgaagacatgttacctcggtgactattttttgacatgttatgccaatgtcattaataaatgataatagagaccattttaaattttaaaaatttatatgaattaaaaccaataaaaaattgaaggattaaaacaagaattcacagtatttatacataataacagtatattttaccaaaacttaaatacgaggcattatgggaaaagtacaagcattgtggaaccttagtgaaaaaaggatagagacaagggaagggtaaggaagatgctgggaaatagttaactgaaaaataaaaaaatctgcaaaaataccttactacagcggcacataaggacttcaattttttcaaatgcaaatctatagatttctagactctaacaaagactaacagttctttgaaatgacccccataataataaaacttgtgaggaaatggaaagtaatcaaaggaggactatggaagtagaactactgtgtgtaaagatttagattgaaatgactgaaatggggagataataacaagagtttatttcatgctactacaatccaaagatataggatatgcttagacaaattgaaaggtgacagtaaggcatggttggaaggttaatattacagacttatgaatgtaatcactttagacacattagtccccataattttaatgttcaaggtattgtaaagattattgtgttactgttaagtttagggttctataacataattgatttctccatatctgagtacctttgtaggagccagattaattaaagacaaaatagtcatagcacatgaggactttcatgctttgaagagaaggagcaaagaaggcacaaaaagaatagccctaaagcttgacgtgagtaaagcctatgagaaattagaatggactttcttggagaaggctctaatagcatatgggtctggggataaatgggctaagttagttatggccttattgtctagtataacatatacagtctaaatgtgttccaaagtcctacagaggcctcaagcccatttattattcttgcctcaaatactctctctcaaatattttagaaagaataaaccattaatttcgtttttaaagtattactgtctcccttaaattatccataaatcaagaaaaccatttaaataatccttaaagtattgaataaccataacttttaatttaagttaatgtatttttaacaaagtttaagaactattttgaaggtattttttaatatttggagaactacttaacacaactttttatacttttgggatcacctgagtagttgtttttttttataaaaaaaatagagagtatttagaagagagtaatatttgaaggatgaattgattattaagaaagctcttacatatggagatttattgtgaaccccttctagcccaactctttcctacgtaccttctatttgaagattatgctcttatctttgggattacttgtgctggagaagctgtccatatttttaacctgtcctgggtcaaaggattaacttagcaaagtctggattaatctttggcaaatatattctactgctactaataaaagagatatctattattagtgtcttaggaaaagaagcttgggaaattgttggtaattatcttggtctcccaacagaatggggcagatctagaaatatcactcttcagtggattagggagaagaggtaactctaatcaaagtcgtctttcaaagggattccctcttatgcaatgcctgttatacactttcctaagtctttttgtacctttctaatttcctcagtagctaggttctgatggaggaataagggtaggaagaggattgcactagaatagttggcaaatattgtcctttggtagcattactaatctagcaaagtagaattggcgggcttatagagacccaaattcattatttttgtttcatgggtttgacacagtattcttcaaggcaaggagtttgttaagtagggtcattgaacaataataaacgagaataaggtaggtattaaatgatagtagatgaattagagccattcgaccccattctaagtttggattatttagttaagagaagctatcatgttgctaaacaaatatcatgtgaagtgagaagatcaatgagctcctcttcataattaaggcaccccatataaggttagacattttctagggaaggtcttccataatgcttttttggtcataacaaacattttcgctatgaagatggctgtctatctactatgtatgttgtcccatctggtgcaagagacaaatcagcatactctattactctgtccctagacctaactagtttgatttaggacacaaatacaatgttatttttattttacgtgtcaaagattaatcaagtacattctatatcccttatgttgtggtactggtatatttggaaagcaagaaacaaattgatcaatcaaaacaatactcataatcctaccatttagtttacatttaatcgttgcaatcattaaaacaatagaatatatgaaaactttttttattattaaaaaccaatataatgtttataataaacaaaacagtttgaattatatgtcacggcacggtttgaagtttttttccccttttagtttaaatacaaaaactcacatgaggttgcattgattcaaaagacacatgaatgttttacaataataaagaatatatgttagttacatattttttttatcattgaattaatttcatatattgggtctcactaaaataattgttcaaatttattcaaaaatatgttgaaaacatcctgttggtaatatttgactttttgttcctcctacagtggcatgtagtttatatttagagaactaaatcaaacacggaatctgtcgtgaaagaagttgatacttgataggttgactgtactataatgctactagaattgtgcacaatagataactttattatttctttaagtatttctccttttttttttatcagttatgtatttctgatttaaaattttaaaaaaagaggtcttaatcagtgtatttgcatttaataattttttggcatggatattcgaaacagacaataaaggtaaaaaattgattgggaaaaaaataaaactcgtttaaaattgaaatgagctacaaaaagcgtacactagacgtaggttgtattaaattaatcttatggagatcaaagctgaaaattgatagggactactacatactgggtgtttctgtttccccttaccttctcacattatcacacgtcattagatactatacattgatctagtctataattattagatgacacgaagttggtgaatgtctatgtcaatttcccaccccacaacatgattgaataatttagacccttcttacagagttctggtaataaaagtctcgttattttaaagatttataaatgcttgtcgttctaaattggaccaacaaacaattatttgaggctaatcgagtttataccacatttattagaaattctcaactcatatagctttacacaaacgagtaactcatttcaacttttaagtgaaatggcaaacccttggcttattggactgggaaaattgcactctatgtatattacaactttgtggaagttgtataactaatattattttccgactcgtgtaagggctattcaattttgtcatggactttgatttcacttaatactatactacatccgatcctttttactaaaaacaacaaaaaagtaatagtctaaaatatattatcacttgtttcttgtaaaaaatacggtaggtaatagcacccaaatggggaaaaaatagcattaaaaacatagaaaaaaaatgattcacgcatcaatgatgtagagagtaataatttttatatacttctgttttctaacaactccttctccaccttctttttctttgtataattgtatctgttgttttcgctcatcacatttcttattttctatcccatcacttcttatcactctcacagaatctttattcattacagagtaataaaggaatagggaagtagaccaaggctttgacagttggacttgtgcacagggaaaacaaaggggaaaagaaaacaaaaactcacagaaaatcacagtcaaagtaaaatagaaaaacacttatatccttcaaaatgttttatggctctataattatgattcaccattaagtttgtatggatgctcaaaaccacacatctgatcccatgaatttgttataacagaaggagaatgaaaccagttatgattgccacaaccaatttgattcattgttttcatggtaaatggctaaacaattcttttatataccccaactccccaagcatatgaacacaacatccattcctaaataacctctaactacaaaccccactatacatcccaaatgtaaaagagctactatcatgtttggataacacataagaatcaattctaccccatataatcaggtgataccataaaaaaagtagaagaaactatttgttgtttttacctacaccatgaaaaattaattgattatgttttaccataaagctacatcactactcaagagacccctttatagtgattcaaggaaaccagtttttgagagtacagcattcctcactttgctaagatccctacctttgagggttctcccagcaccttctaaaacagaaaatgaggatatctgactccttgcaagccttctggcaataaactcatgtggaggaagcttatcactgtcatcattttcctctccatcctcatcactactcccaccatagttagcaacaccatcatcatcaccatcataatcaccatcaaaccttgaactagcactattcttggggggtttagtgctataaatctttgaccagtcaggaatgttgacaggtgctgattgctgaagaaccttatcttcattggaggaactagcactgctgctattgctagatcttgggatcattctggctgaactaggcctagcaggaacaggaacaggaacaggaacagaagaggattgatctttgtctttgaacttgcgaaccccagaagtaccataatcactacttctgttcttgaaaacatcccaaacttcttcttcatcaaagtctccatctctcaaggacttccatatcccactatgctgcctgcctagactatatttatcttccatcacaaatcaatcacttcctgcatagtcacataacacaaatgtgaagaaaattatctcaaattattgaactagaattttcactggtttaagcaaaagacaagaaggagaatttggaaattaaggggagaaattaagaaccaaaactataaatcacagggggtgattatatttgatacaataagatatttggtattttattgaggaaaaataaaaggaaccacctttatgttgttgttgttgttgtcctggaatcagaagcgtgaaataacccaactttatattgattctaaagtggtttcttgctggaatatgcaaagaaaaaatgagttgtgaaatgagagatgagtcagcttgaattaattctgataccataagaacttgaatttgactgaatatatatgacggtgagtcaaaatccataatattatggcttacctgaacaagtttgcagagagattataggagaaacagcaaagcaaagagagagcaagttcgttctttctgaaggggaaagaatgagacactgaatgataggtgtccacgtatttaactctggtacctcacaggattaactttttacgacgtagtacatgtacatgcccactatcttttttattttcaacacctctgttctgagttctgaccgtctaaactttaaataattcaattactaccttttatttttatttatatcgcatttattactaataactcatattatcaattcgagttaatgttgatgcacgaataatttaattcattttatactatcatttaattataaattattatttaaattagtttaagataattattttaaaaattatcaaatttatcataaaattattattagatgattatatattttttctctttccatgagtccaccaagatttttgtttttattttttatttttttcacctactcattcacaaccatttccatataagtgatgattaattgagtttagtatacagtccaaaaaataaatttgagttgagtatatgttgtgaatctctaatgcatctatatttatacgaggaatagtcatttgatcctaaaattatagtgaattattacatgtccttgtcgtaaaaaaaatataagtccttgaaaataaaaataaaaactaaaaaataaatagctgaacttttttagaattttagttaacttgttaaaaattaatcattttgttgcttttaaataagaatcctaaatggtaataataacatgtgtataaaaaataattttattattattactatattttttgttaccatagtaatgctgtgaaatattcatcaatttcaatgatcattaatctttattcattgatcatcatagtaaatatatttttttcatcatcatttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactgatattaaaattagatgctatatttgttaaatacaagcataattagcttcaataatacattgactataacatacacattcatctattataatatattatgttgattaatgaattttcatattgataaatgtttttttataaaattattatcataattgaaaattaagaatttcatacctgaaaatatagtttcaagaaacttattattttcattattatttggagcatattataatgtataaacttgttgaaataaaaggtaatcaaatgcttaatcttataatacaaaaaattaatgaatatataatatatttttttaaagaaaattcataaattttgagaaattaactataaatataataaattaaaataaaatatttaaattcaataagatggaagtcaacaaatacatattaaactaataatacgagaaaacatgaaaatattgtaatatatgatattaatattgttattatcttctatttatatttaacactatctctctctctccctccctccccacccccacatataaataattaacagtacattaatattaaatactatgtttattaaataatgtaatatatattccatgaaaattaataatgtaatatataattaatttaaattaaactattaaatgacatggtaattaattatgacatgtttctaagctatatactttttcatgataataaataataaatatattaaaagaatattacataaaagatagttattacaaactgtactcttaaaaataagatagttataataagataaatttataagcatattatataattaaaattaatttcacattaatattaaatgttatattaattaaatgtaatacataactaacttaaatacatattacatgcactaatttcaatatatttccccgatacatgaatttccatgttaataaatatatttaaaaattattaaaatttcatacataaaaagtatactaaaaattattttttcattattatttataataaattaatgtttcatttgtaactactagtatattaccattaaataaagttgataatttcttttattgattttttattgaaaatttatattattatacaaaacatgttacctacaataaaatttgttaataaattataaactaataaaaaattattttctcaacatctttttttatatatattttaaattgtatgtttttttctccatatttatacaaattctcacgcacctcttgagatagagaacatttaccctttcaataagtacccaaaactgatgattaattttttccttcagtatttctttcattaaataattttatactatcattcaatcataaattattattttttataaaaaaaaatttagtatttaatattaataaacaggctgccataacatgtgtcaaccagaaaagttatacaagcacaacatagtaagtgtgatgctgcaatcatgatccaataagaaatcacataaatattgcagccatgtattcaccatagtagatccaatcccaaaacaataaaccaagtagacccgtgctcactcatgcatacaacggcactcaggggatctattttccaaacatacaaggagaaatcgaatccttttatcatggctttacaccagttccatgccctatatccaaattcatcacaaatcaaggttgataatgatataacttaataaacgcgagtgacatttgattattggctattaatggaacattaattgagaattaactctgattaaattgtggtcgtgtcatttaataaatttttagatcctcttcgggttaaaatgttgtattgaagaacatatgcttgaaaattctaaggaagactacaagaaacgatggtatatacagcccccttgaatgggtggcgaacagataaagacaggctattctcgaggaaacagacaacagacaaaagagtctaagtttcaacaacacatgaatacaaatgttggaaattgtgtaaaaaaatacttatgatgcacatttgacccaaattatacgaccattttttgtcttgtcttcctctttttgttttttctttaacttattttcatcttagagcatacatttttattaccatatcatcaatagggaaggatatatatgatatactgatgtttgtgattagagtgataaggttacaaatatattttttagtacatttttagtatattataggagtattttaaatttaaatgaaatttctaaattaaaaataatttcaatattatcaatatattttattttattttatgaaaataaataaaatatatagtatttttaaaatttagaagaaaaatataaaaaaatatgttttttatatataactttaaatttaaaaataaatttaaattacggttatagggactatgataattttaaaattccttttagtttaaaaaatatatatttaatttacaatgcattaaaaattaaaattaaaattaaattaaattaaagtaacagtatttgaaaatataaatataaagtcacgtaaattaataaaaaaagaaaacatttcttaaaactgatctcatttaaaaataaaaagactcaaatatgtaatgtgaacaagatctcaaatagagtcttgcaaatggaaaaaattgttaaggagcttaaataaatccatccaattcaaattaattataatctaccaacattaacatattaattgtgatgaaacttgatgtaaatccttaagtaagggtcttacatttatgtcttatgaataataaaaaagtaattaaaaatagatatttgttaaaaataattagtcaggttatcaatgaaaaatatatagtaattaataagtaaaaataataaatattttacatctattacatagttatatatatatatatatatatatatatattccaatgagacttttaaatacgttaatttaatataaaaaataaagttgaaaggaaggtaacgtaaaactattagtagataaaaaatgaaaaagttaaaattctataaggagaaagaaaattagcacacggaaatgatctctgttctggcacagcatttgctttgtcaaagtttttaattctttttttttcttttctgaaaaaaactgtgtaaattgaaaccaaagggaaatggttcgtggaagtttctgatgttgaagaagatcaacgtggcccacatacaccaattgccaatccaccattcaacgtatatggatatgaaattttgtcagctgggagaataactcccaggatttagtgggaatcttatgtaaagaattaatctgctatataagattttccaccgttggagcagaatcttcttgctaaaagctaagccatgcacagcattgaggtggcggctgtaaagtgacagcactggtgttgagtacgataatcaacacttagcacagttaactgattttagtcataattaaaaatttatatattagtaattgttatgtcacttaattatttgatctcagctcaattttttgttgttgtattaatgggaattgaaaacagtgtcattaagcggtttgtaataactcaaggtttgaatatatgcaacagaaatgtaattgaaactgacggcaatatatctcacttacttagccttacctttcttaatttcctgcaaattaaagttacgttggttgtctaatgtgcatcactgatgttggatattattggattacgtgcaaatgttttaattttgtattatactatgtaatacggatatacttgacgatgtttattatatatttttctgttggcgtatattaattgagagttttgtacgtgttttaatttccttctttctttctttttaggtgggtgtggggttagagctagtatctgagcactgaagtatatttacgatggtgaagaaatgcgtatattacactcaagaattaatgccatatatgccaatcaatctcatccagtgttcaccaaaaatgtagtttacgcagctgacaaggtagctgtatgtcataattcattaagtagtagcaagtgaagacaaaccccacgttcagccaaaaagttttcatagataacgatatgggaatgtaggccaaaccacgtgcattaggaggctatatttgtttctagtattttttgctttcaaagttcaaacatttactgatatatggtcacaattaatctacctgcaatgtacgtgaaatatggagacagacatacataactttggcttcaatccattttaagtttattttttttatatattctacaattgaaattagaggtgtatttaataatcattatttatctttaatgccgaatttaattatagaggttataaaagtaaaattataattttaatgaggagaacaacgacaaaaagtatttctaattaagttgtatcctatttgttttttattggctcaaagctaggaaacacgtgtctctcacaaaccttcaggttgaaagtacgttgaagggttggtgccctttataggtgatctttttagttaggtatgatgagacgaaggtcacaactgtaaatgcctctaatatatgctttcagtcagtaagagtaagagttaagacgtggttagtgtttaaggcgtacttggtatatgatgctaattaagtcttctttataggcctttttcttagtgttcatatatatgacaagagattagatgagataacatgataatttgttacctattatggaatttaattatcattaagcgagatgataagaggttaactattaaaatgtaatatgttacctattggtgttaaagacacaattaagtgtatcaatcgtacgtacaactaatatatatactagaatgtatgagtaaatctttgtttgagaaattaaaaaaggaagtaattacattttagtttttggtattcaataaaaattagagaagaacagacacaaatggacaactaagaaaaaaattcaataggcaagaatggtaggtattagaaatgctaggcatggggttgtagaaattaatttccagaatactattttagttttttttgttccagaaagtacatttcaaaatgcaattgggtatcatgtaacatacaacatacaaaaaatacatgaaatagaataatgcaatttgatagaaaaatagaatgagtgggaaggttgtgcagaagcgcttgttgatatattttgggccacatttaaaaaaaaaagatgttttaggccttgggccaaactagtacacaaattagtttcactactgaattgtcccacagatgagtaattaaaccggtggtgaaaacatgcgtagaaaaccaagtgtatgtttaagacaatttttttttatcaacaaatattaatttgttaatttagttagaaatactaattgggagaatgcgagaaatgttagtttgttgtatacccttctatattccaaaatgccccttcgcaatggacaaagcattgtttggcctagttaatgcatcattcctggttttatttgaagtccatttgttgaagtttcctatgcaaataaataccacataatatgatcttgtgcatactttatagaggtacaactgtaaaagggtgctggtctggacaccattatcttggctctcaagattgggctgccaagggtcctttactactcgtgagctcaccaatgacaaaatgttatttcattatatttgtaagtttaatttttatacattatcagcgtaaattggtactaattttatggtaggtatagaaaaagttaacaaatttaatatatatcataaatatcataatttgtaatagatgacagtaaaactctatagtctcactatttgagtatatttattggactgctttcttgttttacaaatattttttcacttgcttgttcacattgggggtgaaaggagttattgcaagagctttgagagaattcaccgtggtaatctagttgggatggggatcatacccctctgcttcaaacatgaagaacacaagaagtgacgggtcatgagtgattcaactttgatcttccaggaaaagttggtgacacagaacctggtcaagatgtttatgtgtccactgacattaattggcaaatcttttaaatgcaagctttgccttgatataagtttcttaattcatgtgccttctatatatggtttatcatctaagattgatcaatgcacttgcatacagtggcttcactaatcactatgatatatacttatttagcaactcaatttgcaggtggagttggcataccttgatcatggtggcattcttccctatgttatccgaaacttgattaagcaatgagcttttgtctctttggatttctgaggcacaccatcaccatgtgaaatgtgtggaacacaataaattccattttagattattttacgcatggatctgaatgtacttaatggcaaatcaatatgtttatgcaatgtttaattttcatgtattttatctattttatttaacacttcactgtactacaaaactgttaatctcaattatcatattacagtcaatccattgtttttattttttactaacttgagcgtgagacataaaactaaaaagatatattaattttttttaaaaattaataaaaatgaagaggataattattgtttgaatttatgatctattattttaaataataaataaaaaactgaggcatgttgcaataacgtacagtaattaatataaacgagtatggatttaattaattaactttagctccaaaacattaactgtataaaatattattatcaaattattaatgataatcataaaaaactaagcctataaccaaatattctgatacttcacttgcttttatagcagcctttcacgtactgatcattactttttaattattatcaccccaatataaatcttacaattttgttttataatatttctgatgaactaaaaaatattaacttaaaaaaattaataacaaacatcataaagttgtttgaaaagccaaaaatactcgttataaagaaaagaaaaaaaaaacacgaatttgtttgcatttttattatttagaaaaatgaattcttatttcctttaactcatttatctttaaataaaatccaactaattatatttatttcgaacatatatatatatatatatatatatatatatatatattgttggcaaaaacaaattaagctgagaaatgaaagggaagagaggaagcaagtgtgacactgttccccaattttctgtgcttagagtgaagcatttcgaaacagcaagacacgatgccttcggctcaagatccattctacgttgtcaagcaagaaattcaagaatctgtaagtattttctcttttcccaaatcacctaggtttcgttttcggttcaatttggataataaagattacattcttttttttcatagatcatgcgatgcacttagaatttctgtatgatttctctgttactggtattagtggatccgtgactttacgtgattcatcttctcaagcctgattcctgagctgaaattattaattgggatatttttgctcctaatatcttatgtaattgatctgagtatgccattttttaatgcaaattttggattttggatagaacccaactgcgatctgtaattggaggataacactatgatttttggttttggggttgatgtgtaatttattggcttattaattttcattttctggtaagattgataagctgcaatctacgtttcaccaatgggaaaagactgctgatgctggcgagcgatccaatctatcaaaggaagttcttgctagttgtgaaagcattgaatggcaggtataccaattgtatttttttgaaccactgacaagttggttggcctataaatttttgttttaaatgagttttattcattcttccaacgtggtactagtatcatttgtatgaaatgggatttgtgtattattaggtacacgttagagggatgtttggattatatacaatctaggtcagaggtagggaaaggtatttcctgggggaaattttattgtggtaggaaggaaaaagagtgatgtgcacataactgtccaaaatgattctgacatatgctgcaatttttgtcaaatacatggtatttttttttttatcacaaaaaagcagaagaatcattcactctgtgatcattgtgaggatgcaaatctttgtaaatttcagctaaatatcattgttaaattttaatgttaattagttaatataagagcttaataaatagtgaaatgcattatattcatgtatttttattcatcattccattccctcccccccattgtattttttagccacccaataaagggagagcaagatcatgaataccctctcccttttttccctcttgttttcttttaatttgattttgccccttccctttgggtctgtaaggaaagatgaaggggagtaaaaatggagtgagctggaaatgttttgattttcactctttgttggttgttaaatcagagagtggaaaacagatagaaagttacttctaactctactagcacatcttttatctagcctctctttgccacacatcttaggctatggtttttccttctgcaatacaacctattcaaactgctaaaatataatttttttgataggaaggtggatgaattggacaaagcaatttctgtagcctctagagatccttcttggtatggcattgatgaagtggaggttgaaaaccggaggacgtggacccgtgatgctcgcacccaggtatctataacatgctgatcttgagtaagagttaggagaatacagtcaaattttttctcaacctaatgtatagttcattcaacattgttttattgctagcacctattagattccctctctctctgttttttttttttttatctgtatggtgcttgtgaatgattgtaatacattattaggtgagcacagcaaagaaagcagtgcaagctggaaagggcttaaacaatgctagtctaaatgggatgcacaaggaattaatgaggcttcctagttctcatcaaactacatctaaccaatttgctgcccaggataatgatgatttcatagagtcagaatcggacaggcagatgcttcttataaagtacttctttcctcccattttctctctctcactttatatggcattgaattaaatatttgtcttttgtcctgcttttacttgactttgtgcacatcttcatgatattaaactccttgacacttgaccgtgacttttgtgcatgcaaggtggaaaatattctggtaattagtttgacctcttaagttgattgaattatattgtccactcctcctctatgctttctgagacgtaagtgggctcctctgtatgaaattgtggacacatgaacatatttttcttgtgcttctttacaaattataaatttctgttttttaatatcatctttgctaattatttaagttttgtttggattatactatttctattaaataagaaatattaactaaaatgatggattcccctttttttctgtggaagaaaaagaaaatgggggagagtaaagactgtggcaggtagccttaacacagataaaggctggaaatacagtgctcaagtgttttcggaaaataatcaatctctggtttctattttatttttgtcttatattttatctattggtgctgataggagacaagatgaggagttggatgagcttagtttaagtgtacaaagaataggaggtgttggacttactatacatgaagagctccttgcgcaggtagatttgacatttgacaagtttttggtctgtgatcttactattttgcttagtgggagagccttgttgctgtcttgtgagttggatgttactggtgtaaatcctggaaacagcctctccccttgcggggttaaggcattttttctcgtgtttcaaaagtatgaaactaggcaaaactggtggtgcttatgtttcctttgagtgtcttcaatagtagctgtgttctcatgctgattttgtttccgtgggaaatttctcattctaaaattgtcaaagccttgatgtttcaggaaaagattattgatgaactgggtaatgagatggacattacttctaatcgcctagattttgtccaagtgagtttctgcttcgagtttccattattgcattaaaatgtatgatctatctggctgattgctgtgattaattagtaataatataaggagggcgagccctggcacaacggtaaagttgtgttttggtgacttgttgatcatgggttcgaatccggaaatagtctctttgcatatgcaagggtaaaactgcgtaaaatatcccttttccttnnnnnnnnnnnnnnnnttttttttttttttttttttttaatataaggagggaaatttttaatgttgaatgtgaaagttgaactgtgtctcattgtttatgatatcagaaaaaagtggcaatggtcatgaagaaggctagtgcaaagggacagatcatgatgatattgggtttgttggtgctgttcattttcctctttttcttggttttcttcacctagttattgagatgaaccttgtcaatgctctgtttgtacatggaaaaagatctaaagcttctgtgaagatacaagattattgggagattcaatatgtttaaaaaatgaatggaagcctctttggtttgtcaaaggcagtagaaaattttgattatgatgaaaagagaagcgatgtacttggaaatatcagaagaggaatttgtttctgaacaagatggattacaaatgtgatttaaattagttgtattcgttttaaagatgatttaaccctgcatgtaatgtttgatgtcgtttttttttctttttataacgacagcgtggtgttttgaatttatactttcatgactgtaccaaaatagcttatgatctatcttcatacaaatcaacccattatttacctgctcactcctggtggcatgatgatcttgtcggttgctgttttgtgttggcacagtagaatattgaggggaggataacatgttatctaatttggccagatatttcaaggtgtaatttttatgcaattgataaaaaatgaaaaatgaaggctgttgtattagtcattttgtgtctgttcagtattggtttgcttaagagtggtagggtgaaaaataaggtaatcatagccttcgttgaataaaagaaaaagtaaaaataaaagggaaattggatatgtatatatgttatgcttggaaaaatccctttttttttatttataaaaataactgagaaagataagaaggaaaacaagaatataataaaatcgataatgtgataaaaaaaaattaaaagataaagaaacgacttaaatgatttcctctaagtctgggttaccaaggtattatgtgagcgtcgcttgtctgagttccgagtttacatagtgccggttgttggagttttcaacgctccagtaactaagaaatgtcaaaataaatattaaaaaatagttttcttataattttttttaattttattatttattttgtaaggcaaatattggtttttttttatatttctaaaatattaaatgtttttacatttttatttaattctttacagtattaagaagatttgtaagaagatctataagaagatataatgttattttgttggaaatgttttataaaaaaaaaatactggaatttgtagagaaattgagagattaaaattcaagaaataaaattgtaattaaatttcataaaaagaattcatgtgtataggcttaaaatcaacatcttcctcaaaaatctgatatgttaattttgttaaaggtttaaatatgttttatccataataaatacttaaaatttgtatttgctttttaagaaatttttattttgtgtcgagtttctaataaaataataattttgtttgagtatctgataaatgaaaaaaaattattaggaacttaaaaaaatgtcaatgaccaaaaaaaaattgttattttattagagagttaaagtaaaataaaaatctattagaaataaaatgtaaaatttaaatatttattataaataaaaatatatttaaaccttttgttaaactgggagaaagtatcattgtgatctacataaatttttaattactatttaagaaatctaagagtttaattaatactttatatgattatatcattagctgataatattataaaaattgtaaaaaatatttcaaatttaaattatatacttacggtgaatttaaaagcagaaagatataaataaacctacttaatgcattggaaagaagttagaaggcaggggaagtctactcacatgtaaaaataaaaagtaaaaatccagaaatatcatactgatcaataatttcctttgcagtatcattaattggactggaataattttgtttttcttttgtaaaaggatttgaaacaattattttttgtcccgatctttcttttgatcttctacagacaaatattataaaataatgcaaattgagaagtgataaaaattaaaagaattcgtatctgtaacactcagacaagcataaggaacagaatctccaaagcaatttgagtctagattcttctttcctttgttcttgttctctactacaactactatataccacacaaattatcttgcgtttctatgccttaaattacaaccagatatcaatcccatggagaataggatactccatccacccaaaaacaccttatattctgctattaaccatcaatagacccattgcaatctgtgagaaattgtcacattgtaagaattttttatttattttcagacatgtaaatcaatatttaacatctgtaaacttatatcaatatataatatatacacacatttaaaaaattactttatactatcaaatgtttaattgcatggtgtaaataatttgtcctaaaaaatttcactgctattaaattgcttattctgtcacgcacaccccgctactatatatacccccaccactacctattcttctcaattcgctcttgctttgtttacaagtcctcctttctcacaggttcgtctctccttcaacattagatcttcctagcacatttttaattcctacttggtctaaaaaattgtgtttgtgaaagtttgagttccaagtttaatgtctctattacacaagaaagacattttattctcttttttttgctactttccttacgaattatatgtacttgcaagatgtgaaggaaagatttgattttaatccataaggttgacataactgtgtaataatgcaccattgcgttcatatatgagagaagatgtatttaatgaaaaaatttgtatttgatttcttctttgtgcaaatttttttgaatcaaaagcagtcacgcacctcgagtgagattagtttctaaacttaatgaattgagaggcattcatgatctctgacacaaaacaataaaaccgcgtgaaggaaagaaatgcttaataggaggctttagatttgttatggttagatatgttgatattggcatgcatgcatgaacatgtcacatgtggcttatggtgttttacattttgttgcagctagggtggtgattagtgtacatatatatatatggttgaagtgggtatttatcacatccctacaagcactttcgacccatttgcggaggcaaaagaaacagatgcccccggggcaaaagagtatgtgcatatccgcatacaacagaggaatgggaagaagagtctgaccacagtgcaagggctgaagaaagagttcagctacgagaagatcctcaaagacctcaagaaagagttttgctgcaatggcaatgttgtgcatgacaaggagcttggcaagattatccaactccaaggtgatcagcgcaagaacgtttctcacttcctcattcatgctcgccttgttaggaaggatcagatcaagattcatggtttctaaccaactaccactaccacctttcttgtattatgaaattaaacctatggctgcgtttatgaaataactaaggagtttgagtttggaatatttggtcattttctctctgtatgattgaaaatccaagaatagtctgagagttgttatatatattactacatgttgtgctttcatggaccatgttttaagctatttttatctgattttaatttttaattaagagtatcagtttaacaattctaaatttataagaccactataagttcaaacaaaataagttgttatatatgtgctaatatatatgaaataatgcgttgcctgcccttcaagaatcacttttaattttaagattagaaaagaaaagaatataaacaagaaccaaggctatttacttgcatgtgtgagacatttctcttgcctcgtaatcattagttctttgatgcaaggttgccttttttgagataagaaaaaaactttaatacaatggttcttgtacatttgttctacttaacacttgatcgcatgtgttaacaagattttatagttattatgacaaaggaaaatgtgtgggagatactttgatgttttaatatgcacaaatccgtgaatacatgcatgtatgataaaattgtcttatatatgattaaataataatttatgaaattttacattattttcaatgttattaaaattggttcgaaccgaccggttgaaccggttgaactaggaacctagtatcaatcgggccgagttggctaatgaaccggccatgcatatggcccaaagaaaaccatacggttttaggaaaaaccgaaaatctagccgatttttaggacccagactgagttggtgaagaaaaaaaaaagcttcagacgcataaaacgcaaaaaaaagcttcaacttttcttcatcttcaattcttcatttgttcacggcttagctcagggcctcaggcactcacgctcactgcagcagggcatgccatctccgtcattactagcgtgtgtgggtgcaacacagtgtagagagtgacgatggaggaagtgagaatgacttcggacggagcaacgttgatggcgacgaataagaggaaaccgtcgtggagggagagagagaacaacctccaaatgtagagatgatcgaagagaagattatatatatatatatatatatattgagagtttagttttttttagttgggcttgactagatgttgcttcttgtatcccatttattattttatgcaatttttattttgcatgcgaattagcttattgttattttggatttttgagtatgaaattatggatgaacttttcttaatcaaataatattagttatatacatatatataatataattttaatttttttaatatagactggctcaaaccaggccaattactggtccaccggttggatcactgacctactatctcaactaggtcaataaccgaaccgatttttataacattgattattttctttcgccgagtttatgttaattatctcttctttcgacctatcttttgattataattaaatcgaatattacaaaatacttaaatttgttcatcgatccaaattattttaattagagtttctccatatcaattacatgtcaacatattttacatgatatcaagagaacctctccaataagttaaatgtatgttttcaaggtctaggcatgttcatttatttgcaacaaattaaagtaactttgaaatctcttttattagttacttgatacattttacaaataagacaacctagctcttacaatttcaaatgactagagtaatcaaataggccgtgtgatttgatataccgagttgcactactctttaattaaacaatacccaataataacaggagatgggagacaccttaataacacatcattctcactcacagatgattatgctcctttaaggccacaagcatcaaggaagcaatagtgttctcggcatcattttttcgagatttttcatcccgtcatgtgaatgaaggatactgttgctatctgaacaacgcaaacatatcacagtgctagtgttgacagcacgtagaagagagagttggcctggttggagatcagggtaagtgcgataaaggttgttggtgatggtgtgattgagaggtggagtctccaataaactccaaatgctcgtaggagacaccctctttagaggagaacttagtgagcttctaattaatagaaataatcattcatacataatataaactactaccttttacacataattcatttccttgcttttacccatgccatttccaccctctcttagcactgcaaaggactatactgcttaagagttcaatgcatgacacgtgcaaaagaacatttgtatgctttaataaccttactagaaattttgacaagcgaataatcaaaagggtgcaataagagtttctagtttataaagagaaataagggaacaaagacacaaatgaaaacgcagtaaatgaaggataaatgtacaagcaaagaaaattggtattttattatttcttgatagtgttggaagtgaataatatcttcagacccttctaaattgacatagaggattttgagggtgatcattcatagatcttttacagtaattatcaagattgaaataacagaccatcacatcacatgtacggcatcttcgttcacagcttgacaagtgcaaaccagagaagagaggagactctgaaggaccaaacctgaagcatatcatgcagtttgagatcattctgaagcacaattctgtcccatccattggtcaagtcgtagaagcagcttcttgaacccttcttgaaacacatgttgcactctctaagagaaggatccaacacaatgacgtgcatgccagaaatcctttcgttttcctctagaaaggactcctccttttgtgtcagaaaattgttggcaattttcatagagaagctggcatcgtttaggtttggattcaagtctgactcagaaagtttcttctgtatcagcaacttcacctcacatcccttcatttcttgaatcttttctttaaatggacttggcaattcatcactgctactgctagcacctttcgttgacgtgccttcttcttcgctctttctttcttcttctctctttctttcgtcttgtcttctgaggatgctattcaaaatctcagtgtcatcatcctcgaggaatgaaaataagtgaggattcctttgttgttccagtttaagcaaggcacggatacccttcctcaaaaatatatcatccgaatctccttctttctttacagctcctcccgaattcttttcctcatttgccattgttatgtatctacgttgcnnnnnnnnnnttttttggacgggaaaaaaaattgagatattgataactgaatcaatttaataaggactgcaaatggtaaacaataaaatttgaaaaaaaagtattagattgaattgaattttaataatatttagataaataattatttttgttcgttataaaaagattaattaagatattcatggatgaatttattaatattatatgaaacaaaaataattatttatctaaaatataatttaatctttatctgtaacaatattttattcaaaataaaaactcaaataaaaatacataatcattaaattaattcttacaaaacaaaaataaatctactttaattttattactacctaatacatttaatacattcaataatattaatagcatgggagcaataaatttcaaactacacacccaacaatctctaatcattgtgtaaaacgaaaaatttacacaatcataaaaaaatcaagttagatccctcgaattgatctttattactaatgtttgactataaaaaaatttacacatccaagtactaaaaaaatttataatttattatcattttagttcataacaaaatcataaaaaatagatatatattcctcgaattgatcttcattactaatgttaataagttaactccaaggctatttacttgcatgtgnnnnnnnnnnctctttctttcttcttctctctttctttcgtcttgtcttctgaggatgctattcaaaatctcagtgtcatcatcctcgaggaatgaaaataagtgaggattcctttgttgttccagtttaagcaaggcacggatacccttcctcaaaaatatatcatccgaatctccttctttctttacagctcctcccgaattcttttcctcatttgccattgttatgtatctacgttgcagattagagaagttttccttactctactctctctctctctctcntatatatatatatatatatatatatatatatatatatatatatatatatccatgagtctagatatagtctctgtcaaataaaaaaaattcagtttttttttttggacgggaaaaaaaattgagatattgataactgaatcaatttaataaggactgcaaaaagtaaacaataaaaagtgaaaaaaaagtattagattgaattgaattttaataatatttagataaatagccatattcgtattaaaagagcctattaagatatttatggatgaatttatgtattatatgaaacaaaaatgattatttatcaaaaatataatttaatctttatctttttaatgtaagaatattttattcaaaatagaatactcagatcaaaatacaaccattaaattaatccttacaaaacaaaaataaatctaacttgatactaatacattcaataatattaatagcatcttagcaatagattttaaactacacacacccaacaatctctaatcattgtgtaaaacgaaaaatttacgcaatcataaaaaagtcaagttagatccctcgaattgatcttcattactaatgtttgatcataaaaaaatttacacacccaacgtactaaaaaaaaattataatttattatcaatttagttcgtaacaaaatcataaaaaataaatatccctcgaattgatcttcattactaatgttaataagttaactccaaggctatttacttgcatgtgtgagacatttttcttgcccagtaagcattagttctttgaagcaaagttgacttttttgagataagaaaaaactaaaatgttttgtttggtccacttaacatttgatattgtatgtgtgtaacaagattttatagttattatgacaaggacaaatgtgtgctgagatactttgatgtttaatgatatacaaattcgtgaatacatatatgtttgataaatttgtcttatgattaaataataattttttaattcttatatcattatcttttggtctagttcctgttaattatctcttccttcagcctagcgtttgactataattaaattgaacagtacaaaatacataaatttgtttaatcgatccaaattgtttttaattgatataatttacgtacattgttattatttataaatgtaacttttatttgagtttctttatatatggattacatgtctacatattttacttaatatcaggggatgctttccaataagttaatatgttttcaaggtctaggtagattcatttgtttgcaacaaattgaagtaaatttgaaatctctttcattaattgttttttgatatattgatacattttacaaataaggcaacctagctctctcaatttcacgaacaaatgatcaaagtaatcaaataggcctagtgatttcacataccaaggaaataacccaagtcccacatcaactagagataatgtcaagtcagagtatataagtggagaacaatcctcaccctatgagctagcttctgagattgagttaggttaaaattcatagtcacaaatgacaaagcaactttcatcatattgaattatacaaagaatttaaaatttttccactattgcaattgcaatttaaaacctttattattaatcattaataaaacttataattaattatcatcatgattaattgattgcaacgaaatctaacaagtatttgagataaatatcattcattatcatcgtgatagattgataaacgtatgcaaggacctttgatgccttcactaatctggcatgcagcacagggcacagggtaattcttttcggcaatagcatccacaaagcattccagttgctgaacaaggggaggggcactgtggcgaacgcagtggtgacggtgttgtttgtttataagatatattttatgaaattaataacatattcagataaaaaaaattaatttactagaatagaacattaaaaaataatttggattctcagttacggaaccattgatggtgatggatttaggagggcagacagtggtaccctattcacaggcaattagattgtgataccatatagaagaaaagaaagatctgaatttattgatgtataagtgaagtacgagtcagtttaatttgttacataaacaactaaaggatatataacattgttatgcaacaaatgcatagagtttattttttgaattaaagataaactgaagaagtgcttgtagatattcagagatctagggagagctagttccaacaaacttcaactcacatcccttcatttcttgaatctttaatttcttcacatggccttgtaattcttggaatctccaacattattattagcactgctattgcaagcacctttcgtggacgtgccttcttcttctctctttctttcttcttctctctttctttcgtcttgtcttctgaggatgctattcaaaatctcagtgtcatcatcctcgaggaatgaaaataagtgaggattcctttgttgttccagtttaagcaaggcacggatacccttcctcaaaaatatatcatccgaatctccttctttctttacagctcctcccgaattcttttcctcatttgccattgttatgtatctacgttgcatattagaggtttcatttctctactctctctgtacctatatatgagtatacactaacctaacaaattttacaactaatcaaatatactaatttaaaaaatcaaagcggaaaaactggaatattaccaaatcatccgcagtatatataggtactatgagaataagtcttcttaaagaccagtaaatgatgcgaaattatcaagaaaaatatatttatattctttcttattttataatcttctacctaattttttgaattgcattgaaattgaaatatttacaagattgtaattcgaatttagaaaatataatttaaatttcaaaaataatatgttttggtgatgtaaagttatagagtattttattttaaataataactttattcaaaacaaataaaacacgttaattttaatcaatcataagattttgtttttattggatttataattttaattttaagaatacaattttaattaagattgataaatattactgtaattatcaaaagtttaaaattaaaatcacactataattataataacaattaataattttaaaaacaaaaattataaataaaaatttaaaattaagaaaaaatttctcaatgtgaaatcacatattgttcaaggcataacgtgtttaagaaataattgatttatttgaattatgtgctcgtttttataatttaaattatgtatacgtgattagactttttcttataaaaaattaatattactactatactttataaaatatttttggcatatttttatgttggtaaaaaaatttattgtaaagaaaaaaaattgtagatttatttttttagtttatatatatttagttttgccaaaattttggaagaagattagggaaaaaaagaaacaataccaaaattattttaatttgatgttctaatttttattttactagtatgtaagtccatgcaattcacggggaattaataattatattattattgttttattttttaacataatatatcttttattaatatgtaaattttaaatgtgttttatcttagtacttattattaaaaaaagaaccgagtcttaataatattagtgaaattgcagtaaaaaaatatattagtgaaaataagtatgactataggccataaagcattccacttgccgaacaagggtaggagcattgtgaccaaacgcaagggtggaggtaagagacctggccgggttggagataagggtgaaagtgagccaggccgtctatcagggacctttggcctgacctatttaaggactgatctgacttatttactataaagattaaattcaagctttttgaaaagtctatttaaataaaaaggtcagatttaaacttaaaaaaaaaacatgttagatatatcaggctgacctatttattatatatatacatatattaaaacttaaaatagtatatttatttttctaaaaatatttttttttattatgaaggtggatgatcaatcacttcaaaagattatcttaaaatttcatatatatatctatatatatatatatatatatatatatatatatatatatggttgaagtgggtatttatcacatccctacgagcactttcgacccatttgcggaggcaaaagaaacagatgcccccggggcaaaagagtatgtgcatatccgcatacaacagaggaatgggaagaagagtctgaccacagtgcaagggctgaagaaagagttcagctacgagaagatcctcaaagacctcaagcaagagttttgctgcaatggcaatgttgtgcatgacaaggagcttggcaagattatccaactccaaggtgatcagcgcaagaacgtttctcacttcctcattcatgctcgccttgttaggaaggatcagatcaagattcatggtttctaaccaactaccactaccacctttcttgtattatgaaattaaacctatggctgcgtttatgaaataactaaggagtttgagtttggaatatttggtcattttctctctgtatgattgaaaatccaagaatagtctgagagttgttatatatattactacatgttgtgctttcatggaccatgttttaagctatttttatctgattttaatttttaattaagagtatcagtttaacaattctaaatttataagaccactataagttcaaacaaaataagttgttatatatgtgctaatatatatgaaataatgcgttgcctgcccttcaagaatcactttaattttaagattagaaaagaaaagaatataaacaagaaccaaggctatttacttgcatgtgtgagtcatttctgttgcctcgtactcattagttctttgatgcagggttgcctcttttgagataagaaaaaaactttaatacaatgttttttgtacatttggtctacttaacacttaatcgcatgtgttaacaagattttatagttattatgacaaaggaaaatgtgtgggagatactttgatgttttaatatgcacaaatccctgaatacatgcatgtatgataaaattgtcttatatatgattaaataataatttatgaaatctaacattattttcaatgatattaaaattggttcgaatcggccagttggagcggttgaaccgggaacctagcatcaattgggctgagttggctaatgaatcggccatgcgtgtggcccagagaaaatcgttttgggaagaaccaaaaatctcgccggtttttaggtcccagacggggttggtgaagaaaaaaaaaaaggcttcagacgcccaaaatggcgtcgttttgatgccccaggaaaaaatgcttcagacgcataaaacccgaaaaaaagcttcaacttttcttcatcttaaattcttcatttgttcacggcttagttcaaggcctcaggcactcatgctcactgcagcagggcacgccatctccgttgttactagcttgtgtgggtgcgacgcggtgcagagtggtgatgggggaagtgagaatgactttggacggagcaacgtcgacggcgacgaatcggaggaaatcatcgtggagggagagagagaacaacctccaaatgtagagatgatcgaagagaagaatttggtgcaagggagaagcaggaagaaaaaattggtggacagggacgctgcagcaatccaacatgagaagattatatatatatatatatatatatatattgagagattagttttttttagatgggcttgactagatgttgcttcgtgtatcccgtttattattttctacaacttttcttaatcaaataatgttagttatatacatatataatatatttttaatttttttaatatagactgggtcaaaccggaccaattacttgtccaccggttggaccactgacctactgacctcctacctcagttgggacaatgaccggatcaatttttataacactgattattttctttcgccaaatttatgttaattatctcttctttcggcctatcttttgattattattaaatcgaatattacaaaatacttaaatttcttcatcgatccaaattattttaattagagtttctccatatcaattacatgccaacatattttacatgatatcaagagatcctctccaataagttaaatgtatgttttcaaggtctaggcatgttcatttatttgcaacaaattaaagtaactttgaaatctcttttattagttactttgatacattttacaaataagacaacctagctcttacaatttcaaatgactagagtaaccaaataggccgtgtgatttgatataccgagttgcactactctttaattaaacaatacccaataataacaggagatgggagacaccttaataacacgtcattctcactcacagatgattatgctcctttaaggccacaagcatcaaggaagcaatagtgttctcggcatcattttttcgagatttttcatcccgtcatgggaatgaaggatactgttgctatctgaacaacgcaaacatatcacagtgctagtgttgacagcacgtagaagagagagttggcctggttggagatcagggtaagtgcgataaaggttgttggtgatggtgtgattgagaggtggagtctccaataaactccaaatgctcgtaggagacaccctctttagaggagaacttagtgagcttctaattaatagaaataatcattcatacataatataaactattaccttttacacataattcatttccttgcttttacccatgccatttccaccctctcttagcactgcaaaggactatactgcttaagagttcaatgcatgacacatgcaaaagaacatttgtatgctttaataaccttactagaaattttgacaagcgaataatcaaaagggtgcaataagagtttctagtttataaagagaaataagggaacaaagacacaaatgaaaacgcagtaaatgaaggataaatgtacaagcaaagaaaattggtactttattatttcttgaaagtgttggaagtgaataatatcttcagacccttctaaattgacatagaggattttgagggtgatcattcatagatcttttacagtaattatcaagattgaaataacagaccatcacatcacatgtacggcatcttcgttcacagcttaacaagtgcaaaccagagaagagaggagactctgaaggaccaaacctgaagcatatcatgcagtttgagatcattctgaagcacaattctgtcccatccattggtcaagtcgtagaagcagcttcttgaacccttcttgaaacacatgttgcactctctaagagaaggatccaacacaatgacgtgcatgccagaaatcctttcgttttcctctagaaaggactcctccttttgtgtcagaaaattgttggcaattttcatagagaagctggcatcgtttaggtttggattcaagtctgactcagaaagtttcttctgtatcagcaacttcacctcacatcccttcatttcttgaatcttttctttaaatggacttggcaattcatcactgttactgctagcacctttcgtggacgtgccttcttcttcgctctttctttcttcttctctctttctttcttcttgtcttctgtggatgctattcaaaatctcagtgtcgtcatcctcgaggaacgaaaataaatgaggattcttttgttgttcctgtgtaagccaggcacggatacccttcctcagtatcttatcaatcgaatcaccttctttctttacagctcctcctgaattcttttcctcatttgccattgttatgtatctacgttgcagattagagaagttttccttactctactctctctctctctctctctatacctctatatatatatccatgagtctagatgtagtctctgtctaataaaaaaattcagttttttttttggacgggaaaaaaaattgagatattgataactgaatcaatttaataaggactgcaaatggtaaacaataaaatttgaaaaaaaagtattagattgaattgaattttaataatatttagataaataattatttttgttcgttataaaaagattaattaagatattcatggatgaatttattaatattatatgaaacaaaaataattatttatctaaaatataatttaatctttatctgtaacaatattttattcaaaataaaaactcaaataaaaatacataatcattaaattaattcttacaaaacaaaaataaatctactttaattttattactacctaatacatttaatacattcaataatattaatagcatgggagcaataaatttcaaactacacacccaacaatctctaatcattgtgtaaaacgaaaaatttacacaatcataaaaaaatcaagttagatccctcgaattgatctttattactaatgtttgactataaaaaaatttacacatccaagtactaaaaaaatttataatttattatcattttagttcataacaaaatcataaaaaatagatatatattcctcgaattgatcttcattactaatgttaataagttaactccaaggctatttacttgcatgtgtgagacatttttcttgcccagtaagcattagttctttgaagcaaagttgacttttttgagataagaaaaaaataaaatgttttgtttggtccacttaacatttgatattgtatgtgtgtaacaagattttatagttattatgacaaggacaaatgtgtgctgagatactttgatgtttaatgatatacaaattcgtgaatacatatatgtttgataaatttgtcttatgattaaataataattttttaattcttatatcattatcttttggtctagttcctgttaattatctcttccttcagcctagcgtttgactataattaaattgaacagtacaaaatacataaatttgttaatcgatccaaattgtttttaattgatataatttacgtacattgttattatttataaatgtaacttttatttgagtttctttatatatggattacatgtctacatattttacttaatatcaggggatgctttccaataagttaatatgttttcaaggtctaggtagattcatttgtttgcaacaaattgaagtaaatttgaaatctctttcattaattgttttttgatatattgatacattttacaaataaggcaacctagctctctcaatttcacgaacaaatgatcaaagtaatcaaataggcctcgtgatttcacataccaagttgtactgctatctaaataataatcatgaagtgttttttttttttttttttggnnnnnnnnnnnnnnnnnnnnnnnnnnnnnngttagctccatattgatgggagacttcatattaacagaggggatagaacatccaattttatttaaggcatcctttgaaactttgaacttttgcaagatacttttgagcagaggtggaggacacaataagctccccgtttataaagagattagcaaagcaatacttaagtctccattccttgaatattttatatggcatgcatatatatctcaacatctggtgtcaccatcgcctggaaaacatgcccagttacctaccatagtcacaaatgacaaagcaactttcatcatattgaattatacaaagaatttaaaaaatttcaactattgcaattgcaatttaaaacctttattattaatcactaataaaacttataattaattatcatcatgattaattgattgcaacgaaatctaacaagtatttgagataaatatgattcattatcatcttgatggattgataaacgtatgcaaggacctttgatgccttcactaatctggcatgcagcacagggtaattgtcttcggcaatagcatccacaaagcattccactgaacaaggggaggggaattgtggcgaacgcagtggtgacggtgttgtttgtttataagatatattttatgaaattaataacatattattcagattaaaaaaaataatttacttgaatagaacattaaaaaataatttggattctcgatcagttccggaaccattgatggtgatggatttaggagggcagacagtggtaccctatacacaggcaattaggttgtgataccatatagaagaaaagaatgatctgaatttattgatggataagtgaagtacgagtcagtttaatttgttacataaacaactaaaggatatataacattgttatgcaacagagttattgtttgaacttgaagacaaatgcatagagtttattttttgaattaaagataaactgaagaagtgcttgtagatattcagagatctagggagagctagttccaacaaacttcacctcacatcccttcatttcttgaatctttaatttgttcacatggccttgtaattcttcgaatctccaacattattattagcactgctattgctagcacctttggtggacgtgccttcttcttctctctttcttgcttcttctctctttctttggtcttgtcttctgaggatgctattcaaaatctcagtgtcgtcatcctggaggaatgaaaataagtgaggattcttttgttgttcctgtgtaagccaggcacggatacccttcctcaaaaatatatcaaccgaatcaccttctttttttacagctcctcccgaattcttttcctcatttgccattgttatgtatctacgttgcatattagaggcttcatttctctactctctctctctgtacctatatataagtatacacaaacctaacaaattttacaactaataaaaatataataatttaaaaaatcaaagcgaaaaaattggaatactatcaaatcatccgcagtatatataggtattctgagaataagtcttcttaaagaccaatgattagtaaatgatgcgaaattttcaagcaaaattatatnnnnnnnnnnnnnnnnnnnnnnnnnnnnnnnnnnnnnnnnnnnnncttttttgttgaattgcattgaaattgaaatatttacaagattgtaattcgaatttagaaaatataatttaaatttcaaaataatatatatgttttggtgatgtaaagttatagagtattttattttcaataataactttattcaaaacaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatacaattttaattaagattgataaatattactgtaattatcaaaagtttaaaattaaaatcacactataattataataacaattaataattttaaaagcaaaaattataaataaaaatttaaaattaagaaaaaatttctcaatgtgtaatcaaatattgttcaaggcataacgtgtttaagaaataattgatttatttgaattatgtgctcgtttttataatttaaattatgtattttttataatattgtttgtaaacgtgattagactttttcttataaaaaattaatattactaatatacgttataaaatatttttggcatatttttatgttggtaaaaaaaattattgtaaagaacaaaattttgtagatttatttttttagtttatatatatttagctttcccaaaaaattaggaagaagattaggaaaaaaaagaagaaacaataccaaaattatttttatttgatgttctaatttttattttactagtatgtaagtccatgcaatgcacggggaattaatttattattgttttattttttaacataatatatcttttattaatatgtaaatttttaaatgtgtttatcttagtacttattattaaaaaaagaactataagtcttaataatattagtgaaattgcagtaaaaaatatattagtgaaaataagtatgactatagaccataaagcattccacttgccgaacaagggtaggggcattgtggccatgacgcaatggtggaggtaagagacctggccgggttggagatcaagctaagtggtgacttctaataaaagcaacttatcttgataattaatatccatttgactttttttttttaatgtattttataaaataaattttatatattataattaaataccaaaattgtgtcatagtatataataaaatgtatttgttttaatatttatataaatgctatattaataatattaaatattctatcaacatgtcaagtataatttaattatataaagtcaaaattagtatatttctaattctaaatattgtattaatatacatttaaattttccttcatcttgaatggaatttttttttaataacattgtatttgaattttatacttaatatatttgttaatgttccattcaactaaattattatttttttatccaaatatcttttttattttacataggatatatgatgaataaaatagtttaatagtcaattacataaatttcttttataatatcattaaatcatatcttattatcatgtacgataaattttaatgttttataataattatattgaaagtcattccaacttgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattaatttttcaagtataatttaattatatatcaattatcaactaatatatttcaaagtctatatatcaaattaataaaaaaaattgtagtttttttgcaataaataagacaattttatcacacatgtattcacaaagttgtgcataattaaacatcaaagtatctccctcacacttaaaaagtttttgaaattattcatgttttttatacttattctactcaataaattatttaaaaggctaaatgtttttgaatttgtttgtattttttatgtttaatagatttcgtgaaattaaagatatttgaaaatttcataatttatttgattcacttaattatttaaaataatattttgggaggaatgtgtttaatttaattaccttaatttaaaataatatttcatgattagtaattaaaatgaataattggggtttaattgaatagagaattgaggagaatgtaaataggtatctaaaatcatgaacctaggtctcttaatttgtcagaaacgttcattagttttcatgaacctatgataaatttgttgtttgggagtctctaatggacttaagttcgttgttactattgtaaaataaatttattatttaacaatatattttacggaccatacatatagtgtaatatattttatggaccacgcatatagtacatgcttaatacttggtggccaaccataacaagtcataagtagaggtagaaagggctcaaggcctaatctgatttatttattaaaaaggtttgacttagacttttttaaaaagtttttctaattaaaaagataaaacttaaactttaaaaatagcttattaaacttaatagattggcttattcataatatatatatatatatatatatatttaatatatgcataaaattattaatattaacattaataaaaccttgatacatttgttttctatttaggtttgttggcctagatttaaaaatattattttgatataaaagaaagacttttataatcaagattttatattttaaattttattgaatttatataataagaatttaaaagatggcatataatattatgtatttataagatttgaaaggatttcatatatttttagaaaacatttaaaatcacaagagtcgtgaaaaaaactaatcaagaaatgttaatgtttagattaaacaaagtaaaaacaatacaattttttaataatcttttagtagctgattaattctaacttcatattcttcataatatatcatttcttcacatatctaaaactatactagtcctttatgtattatcatcttcttatccctactcttgcatttgaacaatagactcaaaaaattatggtcatcattatccagtaatactgaagatgaagatttgaatactagttcaattgaaaatatgacgggtgcactgttcagcgaacaacgatgcctgttgatcagagtgggtaaaacttcatttcttaaatttggagttcccaatacctatatacattagcttttgtctttttaactcaattttgacgatgtcgatgtatcataccatgggttagttgagttgtttttgttgtttgcaatccacgtgctttgaccccttgcaaggtgactagtcgtcggcatgcaaatatttgtctttttttctttttttctttcgaattttgacagatttgttttaccgtcattaacgaaaacatattgtgtttgttgctaaaacatatcttacatttgttttttttttttcttctgaaaaaaaattaatgaagactccggaaccattatccttaaattaatgaaggagtactttatatgatttttatgtttcaatataataaatattaattttttcttacttttatttcctagacaagtatattcagttgttaacattttccttttcagctagcagtgtttgttatcatatatacgacgtcacgcagagttcctactcctatatatatatatatgtgtgtgtgtgtgtgcaccaagctgtatatgataaaaaaaatactagcagttctagaaagcaagcaatttaaaatggaagatgtgaacacgcggaaaattaagcaaccaataatctaacacgttttgatactaataaaccatttgaccatataatgtgagagtttctctgaatgaaggcaacgcgtgaccctaaatattgataaacaaataaggaaaagatatttttgaagcggcaagccaaccttgaccatacattaattatagtggccgcaattaccagaactatatatacacaacggggtggcatcacataatcgtttgagagtaaatttgtattgtatatttctgatcattagttattattctcaatagctatgtacctctcaaacatcttcgggtgcttctccgagggctcaccagaagaatccaaaagatacacatgcgatggtaatgtttgtgttctgaaaaacccgaaggcaaacatggggaaaccacagacattatctaacagcaagaaatcaagacatagccttcggatttcgtttgctcgtcgtgccaaaaggtcttctagttgttagatatatatatatatatatatatatatatatatatatatcactcttgtgaatggagagagagaggctcaggttccatcagcccatcaacactacagggttacgttttattggtttcatatgtgattctttgatcgctttcatctgttgtacaacggcgtagcttattctatatcatttctaaattctacctctagtaatcttaaattcttaaagatattttaacttttatttttaatgttcagttattaattaacaacttatagatctctcatatgctgccctgtttgtgatccttgtgaagtatactttaaagatacgggttgattttgtagcttaaaagctctttagtatatgtattgaatcaatataagagtttggaaaattctgttcgacttttctacttgattaagtaatgcttcttgtgtgagtgaatatatatatccatctagctattttaaatgttcatccggtatctcatttatttttatctttcttcctattgcatcataaatattcatcaaagatttttcttctgtatttatgtcacagaaacagttggtaatgtacattaatgttacaaaggatttgaaaattccaaaaatgaagatagagtagttacacatgagcattttcatcactccaaaatgccctgacagagagagctaaactgactttttttttttttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagctaaactgacttttttttttttttttttttgtttacaaacgagaaaaaaggaaaacaaaaaacaaccaacaagcctaaatcattcttctaggaaacttaatccccaaagcatccaccataagactatcctttaacatctgtgtctgaggagcttcatgcaacagctgaagctgattcgtgcattgatttgcttcccaaaaccaatgctgagaccttaaagcaggaagtttaggatttgtttgccaagttagaagttcttttgaaaactttaattttctattggaaatataattttttttttcagagaagttctcaaaaagatttctaaacttatatctaaatagactcccaatcatctcaaatgctggattcctagcacaccaaataaaccacattatgatggggattagaattccctgcttgcaaatcagctccttcagagcatcaagaccgtcagggacatgcaactgaccaaatccgcggttgacaaagctattatttattcaattactttcaaaagccctaagttccactttaggggtgagagtgagacaagggatatgggaataagtaacgcaatggactaatgggtaacttctcgccaaatccatattaaacaaacaaacgtagcttaagtctatctgttaaacaagttagactattgttttaatttaaggtttatttagttcaaaaattaaatcttaaatcatttaaaaaatctttcagacataataaatctgtgtatttgaatcataattataattatattaacatttcactgtgcgtgatatttaattttgatattttattcttgtttgtatgtttttttttaagtcttgctaatatatttaaaaacttaaactaattaatttacttataattttaagttcattagattatttaaagggaagattctaagctactttaaaaggttttattacaaaggagattttactaattaggatttctaggtcaaaattttaaaagattaggtcagatatttaaaatatctatattatataaataggttagactcggattttaggtttaaaaaatgtattataatcaggttttataaatccttgtctaagacaactctttgctatccttaaaagtgactaaaaattattaaaaaatgatttaagtcaatcatcttccaatatatgtgaataaccacattatgtaattccaaccaaacatgttacatacaagtgtgagcctgtttctcgtgagccgcattagatcgtatttttaaataagctaaactcatcaaatttcatatgatttaagttattaatctttataaataacttcatttggtcttaatctttcaaataaattgttaattttaattcttatcaattttaatttttttaagatttattcatattattttttaactatgacatagatataaatcatctagcatcaataattatgagataatatgtaatgcaacaaattaatgtcacattgtcactaaaatagtgataaaagtattttgaaaatgttaaaatttacaataactaaaacaattttagaatctttaaaaaaatagaaaaataaaaaatgaaatagagtcatttatgagaactaattaagaaacataattttaaaccatcttaatattgagctcatttcaaataaatgcatgagacttagaaaaaaaaatttaatcataagtcatttcaaccttcgtatttccaaagaaaattaaaactaaataaagtcatttatgagaactgaggaacataatttaaccatttttatgtttagtttgtttcaaataaatgcatcaacttcgaacaactttttttaatcataagccacttcaaccttcatatttccatagtttgatacttctaataatcacaagctactccaacctccataatatttatgtcaacctagaaacaaatttacacccgaaacacccgaaacactagttccgaaggggtgtacagtactttacttaaatgttgaactagcagagtcgggtaaaattaaacaaggaaaagcaagttgaggttttgcattcgagacatgtacagaaaaatatagcagcattaagaactaaaaacaagtgatgccttccccatcaattcagataaacaagtaatcataatcaaatcaatatcaaggcaaccgaatttcaaccatttgtaaagaatgtagaaagcatcatcaacaggatttattgcccgctaattgaaaaatctaagtaacgcttgatcatgaactactcctaaatgttttatatggtttcaactctaggatagaacacagacatgctgcattaactcggtagttctcatctggaaaagatggaaagtcttgaagttgttttctgccaaatctgctcaagtcttctgtggcaatcacaaatcctacttaagaaaaccatcataagattcccaacataagcatccaagggaaaacaatcttcccaagcacatggtattcatttcatctgttctaaaagtagcacaaggaaaacaattttttttttttttatgcatgcaagaaggtttttggatgaaattccacaaccagtcaatattcctgtggaagcatccacatcagaaatacaataattccatgtcatagttgccggtctggttgctgagagtcaaccagcacaccagatgattgttttgcaggtgacacaggagattgggaaccaatattcatgttacttggtaccatttctttgggctcatacactgctgcagctgtattattacttgtaagctttgcaactagacttgcattactcgagggtaaagagttgaattccacttgtttcaaacccttgttctcataattgttgaggttcctggtttggacattgagctgctgataaaagagattgacatgagaattgggtcttggctcattagaaccaaacaaggatgatttttcatctgatgtaagcccactactagaacaagctgaaggctgttttccctcatccattggtccattaacagaatattgttccatggtggattccacattcttacaatttgtttcaacctctattaattcagtagtagactgcaacttagtcgctaaactaggttgtggctgggcatgattattaagcattaatactggggttggaagtggttcatactctccaacccaaccacgaccaaatttacagccaggtggcagtgcctgctgaatcttctgggaagcaattttccatgcagtaggtcccagagttgcagcaaaacgagccaaactcctggcatatgaatattcatcttgtggtccaacctggtgccgaaaaatacaacattaatgctttaaagaagaaagctaaactattcaaggattagaaataacaattcactccttttgatacatacactaactagccgtggcttaacttcaccctcaaatgttgtaaatatggaatccgatctagtagctggtagattagacatattatcttgcacagatggtttcctttccaagttggagagcagatccctccctgaaacaataaagtaacagtcaaaagcgaacagctagataatgacagtaatatccaactgagagtatgcaaagttgaacaacgaaggcatgaaatctatgaagcacatatacttcaatttgtttcacgtatccatatccgataccaatactctaaaatacttcatcgatacgtaccgaagaagtatccaaatctataaagcaccaacaattaatagtttaatttgcttcacatatctaatatcgatactctttctatactttaccgatatacttagtggtgaagtatccaagcttttaaagcattttatgaaagtccaatacaactacaagaaacatgtaagcgtgtataatatagaaacactttcccttaatgaaccaaaaataaaaattgttctctttatgtatgattttaagaaaggaataagattcatagtattgttcctatattcaaaataatagaaagtaatttataatgacatgcaatcatttataattttatttttcattagagacatgtaagggaatttcaattaaattaaatggaatgaaagtttctcatcattcagaatttgtacaataattttttttactaatgttcaagaagtatgcttttaatttagtttgcaaaattataattatatatttatcatgtttatgaattttatatatgtatcttacacgtaatgtattatatattttttttaaaataatcgtatcattgtatccgatacagtattgtttctgtgtatcatagcatgaaatagacatttcttctgtgatacctgatatatagttttctgctttctcttgatttgcatcaatcaataaagcattcccctccagaagggcatcaatattgccaggtctttcacatacaacaccttgcattggaagggaagttggcagtacatcaccaatagtagcacgagttgcacctgatgtaaaatcaaagccaacaggttcctgtgaagcatgacccagcggcctcttttctagcttcttaacaagggaattagatctccttttttgttcagacttcagttcactttgagaacgttcagaatcaatccttaacttttcaaactttttccttgctagttcttgtattgatcgtgcctgtaacatatatatagggatcatacagcaagcacaacaaaatttctacttgcgttaatttttcaagggaaagcagtcaattttatacctgtttgtggtatatggtctccgccacattgtattgcattgcatttgaggaaatcaaaaatacatcactctgcgttcaacaattgcattcaaatatttatttgcctttcaaaatcactaaatcaggaagacaatatactatgtacggtttaaaaatggttcagatgataataaggggtagcctaatgcacaacatttgaatggattgcggatattcagcagctgctttaatgcacaaggtttgcggatatataagtggttcaagatgcaaaggggtctttgacaaagggatccaatggaaccatttctctttcttgtagtggcataagggttgaattgattgatgatggaagctttaaaaatgggtctctaattggtaaagacaaggtggaggtcaacctattgtttttgggagaaacaaaattgaacatgtaattgacatcaagagcatcttgagatcttgagttagtattgggcttgaaagttaatttttccatgatttgctttggagctttaggcttgccaagagttgaagtggagagatttgcggatatcttgaattgtaggttcttgagagttccttgtgtacctcgacatgtcaattggcgctaatccaagaagacaagcaacttggagacctactgtggaaaagtatgaaaagaaactagtgggtggagccatacgatcctctcaatgacagatagagcgtgcttaattattttgttttttcatcattacctctttacttcttttccttatttaagatcccatgtggtgtattgaaaaaaatgtgtccatacaaagaaggttcctttggggcggaggggagggtgataggaaaatatcttaggtgaaatgggatgagatatgtagagataaaaataaaggaggtttgggggtaaggtaccttggcacttctaatgtagcattactagcaaaatggaggtgcaatttataccaccaaaaaggcatgttgtggagcaatgtgatggagtcaaagtacagagcatggaaatatttactgaatgataattctttaagagagtattcgatttggtggaggaacattaaaaaagggtgtaggggtgggaagaaaggtaagtggtttgatagtatagtgagatggagggtgggagataggaaaaatactagattttagagggatacatgattaggtcgtgagtcattagctaataagtatcctaggctcttccatatttctaaccaacaagataggattgttgcaagtgttggaagatgggggtgaggtcagggagtggacgttcgagtggcatagagagtgctttgattaggagaaaccctctctggaacaattatatcaaaacttgaattcgatgtcgatgcaaagagaccaaccagacaggtgggaatggcctattgaggcaaaaagaatatattcaacaaagtctacctacaaatcattgcaggtagacaatggcaaggaccaatcagatgacatatggagatttatatggaacaccaatttaccaccaaaagatgtagtgatgatatggaggccatgttggatagattaccaacaaggcccaacctcttaaaaagagatgtgtggctatatagtaaaggaagaagcatcatgccctatttgcttagagaaattgaagtcaattgaacatttgttatttctcagtccaagggctcagtggtgatgggtacaatgttataagtggaaggatatctcaacagtggagtggttatttctttgaaggaggcaacaacaaaatgagtctttatatggtgtgcattgttgtggtgtacatggagatcccgtaataacatgatcttcaacgatgacattttttattcaaagaaaatcctataggaggtcatatatgtaagttggacatggttgaaacgcccacccactaaactcccatactcattacaagaatgggctagcaatgtgtatgcatgtttgggatgatcatataggaaaggtgtttgagagatttttctcaagcaaggggataagttttacagaaattgaaagttggttatgaaatattgggtaatcattcatccaaatatgacataaccaactagatagccacttggatgttacttttctttagattatttacttatggtatatcttatacctctttgatcaatgaaatcatttatgtgttgataaaaaaatgcacaaggttcgaaaatcatactcctcaagggaaaaaaacaagctacatataacttatgctaaatttcatatgattcctataaatagtatactcccgcaaaatttccccactaatttcaatcaaaaacatccaaatcactaatgcctatacaattccattatcaacataagtgaataaatcttgacaaactctattatactgacaagtaagccatttaaatgtttcccctcacacaaatagcatgcaacaacctcttgctctcaacccacataatcatattgcaaaaataaccaaaatatcagaaaagaaaaggaacatcccccaacttcaacagtaacaactgacccatttacacacctcaaattgttccaaggtagaataagatccatttgccaacttcttcctcactgtggcaaagtccatcggatgctcaatcactttgtgataatcaggaagctgcattcaaacataatttgaactttcatcttagattgccttccaaaagcaagattaacaattaacaggaagaaaagccctcatacctctttcagatccactggattcgcatacacaccatatatatctttcctgtcaattcaccaaaagtcatggcatcgccatgcaacaataatagttgaagattgaagatgttatatagatcattcaccacaat
